United States Patent 9,675,668 (MODIFIED POLYNUCLEOTIDES ENCODING HEPATITIS A VIRUS CELLULAR RECEPTOR 2) - sequence listing, part 5

SEQ ID NO: 4763 - DNA, 1248 bp, Homo sapiens
cgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaatttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcgggcagaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccgagatggcatgagcgtgcgtgtggctccccagggcctggagcgggttccaggaatcttcatctcccgcctggtacgtgggggtctggctgagagtacagggctgctggcggtcagtgatgagatcctcgaggtcaatggcattgaagtagccgggaagaccttggaccaagtgacggacatgatggttgccaacagccataacctcattgtcactgtcaagcccgccaaccagcgcaataacgtggtgcgaggggcatctgggcgtttgacaggtcctccctctgcagggcctgggcctgctgagcctgatagtgacgatgacagcagtgacctggtcattgagaaccgccagcctcccagttccaatgggctgtctcaggggcccccgtgctgggacctgcaccctggctgccgacatcctggtacccgcagctctctgccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaataca

SEQ ID NO: 4764 - DNA, 1259 bp, Homo sapiens
gggcggggcggcgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaatttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcgggaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccgagatggcatgagcgtgcgtgtggctccccagggcctggagcgggttccaggaatcttcatctcccgcctggtacgtgggggtctggctgagagtacagggctgctggcggtcagtgatgagatcctcgaggtcaatggcattgaagtagccgggaagaccttggaccaagtgacggacatgatggttgccaacagccataacctcattgtcactgtcaagcccgccaaccagcgcaataacgtggtgcgaggggcatctgggcgtttgacaggtcctccctctgcagggcctgggcctgctgagcctgatagtgacgatgacagcagtgacctggtcattgagaaccgccagcctcccagttccaatgggctgtctcaggggcccccgtgctgggacctgcaccctggctgccgacatcctggtacccgcagctctctgccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaatacagtc

SEQ ID NO: 4765 - DNA, 2740 bp, Homo sapiens
acaataaacagcagctttgcgcggggcgatgcccgagccggtgccgccgcccccgcgccgcgcagccccggccgccaggccttagcccgccccggcccccgccaggccgcgtccccctcccctcccctcccccgcgcgccacccgcgcccgcccccgcccggcaccgcggacccacccggacctcggcggggagatggaggtcctggcggcagagaccacgtcccagcaggagcggctgcaggccatcgcagagaagcggaagcggcaggcggagatcgagaacaagcgccggcagctggaggacgagcggaggcagctgcagcacctgaagtccaaggcactgcgggagcgctggctgctggaggggacgccgtcctcggcctcagagggggatgaggacctgaggaggcagatgcaggacgacgagcagaagacacggctgctggaggactcggtgtccaggttggagaaggaaattgaggtgctggagcgtggagactccgccccagccactgccaaggagaacgcggcggccccgagcccagtccgggccccagccccgagtccagccaaggaggagcgcaagacagaggtggtgatgaattcacagcagacgccggtgggcacgcccaaagacaagcgagtctccaacacgcccctgaggacggttgacggctcccccatgatgaaggcagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcagatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagcccc

SEQ ID NO: 4766 - DNA, 2872 bp, Homo sapiens
acaataaacagcagctttgcgcggggcgatgcccgagccggtgccgccgcccccgcgccgcgcagccccggccgccaggccttagcccgccccggcccccgccaggccgcgtccccctcccctcccctcccccgcgcgccacccgcgcccgcccccgcccggcaccgcggacccacccggacctcggcggggagatggaggtcctggcggcagagaccacgtcccagcaggagcggctgcaggccatcgcagagaagcggaagcggcaggcggagatcgagaacaagcgccggcagctggaggacgagcggaggcagctgcagcacctgaagtccaaggcactgcgggagcgctggctgctggaggggacgccgtcctcggcctcagagggggatgaggacctgaggaggcagatgcaggacgacgagcagaagacacggctgctggaggactcggtgtccaggttggagaaggaaattgaggtgctggagcgtggagactccgccccagccactgccaaggagaacgcggcggccccgagcccagtccgggccccagccccgagtccagccaaggaggagcgcaagacagaggtggtgatgaattcacagcagacgccggtgggcacgcccaaagacaagcgagtctccaacacgcccctgaggacggttgacggctcccccatgatgaaggcagccatgtactcggttgagatcactgtggagaaggacaaggtgacaggggagaccagggtgctgtccagcaccacgctgctccctcggcagccgctccctctgggcatcaaagtctacgaggacgagaccaaagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcagatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagcccc

SEQ ID NO: 4767 - DNA, 1458 bp, Homo sapiens
gtgctttgagggagatgcgtggaccgggcaggccaggacccaacatgctttgagggggacgcaggacgggacagatcaggttggagaaggaaattgaggtgctggagcgtggagactccgccccagccactgccaaggagaacgcggcggccccgagcccagtccgggccccagccccgagtccagccaaggaggagcgcaagacagaggtggtgatgaattcacagcagacgccggtgggcacgcccaaagacaagcgagtctccaacacgcccctgaggacggttgacggctcccccatgatgaaggcagccatgtactcggttgagatcactgtggagaaggacaaggtgacaggggagaccagggtgctgtccagcaccacgctgctccctcggcagccgctccctctgggcatcaaagtctacgaggacgagaccaaagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggtt

SEQ ID NO: 4768 - DNA, 2635 bp, Homo sapiens
ggggcggacgccgctcgccggctggccccatcctccactgcagcagtaacgtcgcggcgggttgcgggtaggactggacgccagagcagccgcgcagcgcctgaaccgctgcgggccgccgcggccgccccttcccaccctcgcctctgctgtctccagcctcgcttctccgactttcctgctcctctgctgccttcgtttctggtcctcggccgtcctcgccgcccgcccagaggagtccccgcgcccgccaagaagccgctttccgctggcccgcagccgccgcgacttcggcacagtttctccctctggctagtctcccaaacggccgctcctcgcccgcgggaagaccaggctgcgaccgcgaacgcccgatcctctccaggagccgcagcgagcgcccggcggccacgccccgcgaccacaccccggcggctctcggcccagcgcgcctgccttcgccgcccgccgtcgctcctcgcccgctgcacgacgacgcgacgcccctgctgcaggcggcggacccgaccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagagagctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggagggacatcccagggcctggagaggaaacctttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacatctttgtcagagaatagttcttgttcatactgagtgttctaaatttgaagttatatatacaaattaaaatatttt

SEQ ID NO: 4769 - DNA, 2123 bp, Homo sapiens
cgctgctcgctcgctcgctcgctcgctcgccctcagcgcatgggccccgcgccgggccccggggcctcgggccgccgggacgccggggtcccataggccggggcgtgggcggggcggccagcctgacgcagctctgcaccccctaccaccaccagggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaa

SEQ ID NO: 4770 - DNA, 2070 bp, Homo sapiens
ggcagaagagtatgatcctggcagaggaagcagcaaggacaaagatgaggaaactgaggtccagacagccgaagagtggtagtgtccaggacacacaactgggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaaa

SEQ ID NO: 4771 - DNA, 1914 bp, Homo sapiens
gagggggtgggggcgggagaggcccgggagggcgcgggggagggaagaggcgcccggccggggagaaggggagcggcagacgccgaggcgagggatgcgcgcggcgggcggtggctccgagcggcggccgggcggggggcgctggaggccaggccggccagcggggggtatcccgagagctccatgaagtccccccggggccgcggacggggcgctggcttggggaggctgtcgggggggccccgacatccatggcaaggcgggggccgcggcggcgcgctcggaggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccacc

SEQ ID NO: 4772 - DNA, 2063 bp, Homo sapiens
cgctgctcgctcgctcgctcgctcgctcgccctcagcgcatgggccccgcgccgggccccggggcctcgggccgccgggacgccggggtcccataggccggggcgtgggcggggcggccagcctgacgcagctctgcaccccctaccaccaccagggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaaa

SEQ ID NO: 4773 - DNA, 1947 bp, Homo sapiens
ggagcggcagacgccgagggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagagg

SEQ ID NO: 4774 - DNA, 2123 bp, Homo sapiens
ccacagaagctgctcagggactatccatggcctccccgtggccaacttgagtctgctctgcagctttaggcccgacttggaaggcccatgggctgcagatgaggaaactgaggtccagacagccgaagagtggtagtgtccaggacacacaactgggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaa

SEQ ID NO: 4775 - DNA, 2713 bp, Homo sapiens
cgcgccgcggcgcagcagcacgcgggttctgagaagcgcgtggctccggcgacaagaccccaagcaccctcggccggtggcccgggcccgaccaccccagctgcgcgtcgttactggccacaagtttgctctgggccagccaagttggcaacttggaagcttctcccgggctctggaggagggtccctgcttcttcctacagccgttccgggcatggccgggctgggggcgtcgctccacgtctggggttggctaatgctcggcagctgcctcctggccagagcccagctggattctgatggcaccattactatagaggagcagattgtccttgtgctgaaagcgaaagtacaatgtgaactcaacatcacagctcaactccaggagggagaaggtaattgtttccctgaatgggatggactcatttgttggcccagaggaacagtggggaaaatatcggctgttccatgccctccttatatttatgacttcaaccataaaggagttgctttccgacactgtaaccccaatggaacatgggattttatgcacagcttaaataaaacatgggccaattattcagactgccttcgctttctgcagccagatatcagcataggaaagcaagaattctttgaacgcctctatgtaatgtataccgttggctactccatctcttttggttccttggctgtggctattctcatcattggttacttcagacgattgcattgcactaggaactatatccacatgcacttatttgtgtctttcatgctgagagctacaagcatctttgtcaaagacagagtagtccatgctcacataggagtaaaggagctggagtccctaataatgcaggatgacccacaaaattccattgaggcaacttctgtggacaaatcacaatatatcgggtgcaagattgctgttgtgatgtttatttacttcctggctacaaattattattggatcctggtggaaggtctctacctgcataatctcatctttgtggctttcttttcggacaccaaatacctgtggggcttcatcttgataggctgggggtttccagcagcatttgttgcagcatgggctgtggcacgagcaactctggctgatgcgaggtgctgggaacttagtgctggagacatcaagtggatttatcaagcaccgatcttagcagctattgggctgaattttattctgtttctgaatacggttagagttctagctaccaaaatctgggagaccaatgcagttgggcatgacacaaggaagcaatacaggaaactggccaaatcgacactggtcctggtcctagtctttggagtgcattacatcgtgttcgtatgcctgcctcactccttcactgggctcgggtgggagatccgcatgcactgtgagctcttcttcaactcctttcagggtttctttgtgtctatcatctactgctactgcaatggagaggttcaggcagaggtgaagaagatgtggagtcggtggaacctctccgtggactggaaaaggacaccgccatgtggcagccgcagatgcggctcagtgctcaccaccgtgacgcacagcaccagcagccagtcacaggtggcggccagcacacgcatggtgcttatctctggcaaagctgccaagatcgccagcagacagcctgacagccacatcactttacctggctatgtctggagtaactcagagcaggactgcctgccacactctttccacgaggagaccaaggaagatagtgggaggcagggagatgatattctaatggagaagccttccaggcctatggaatctaacccagacactgaaggatgccaaggagaaactgaggatgttctctgaatggacatttgtggctgactttcatgggctggtccaatggctggttgtgtgagagggcttggctgatactcctatgcttgagttcaaaggctgaaaattcagttaaggtgttacttaataatagtttttaggctccatgaattggctcctgtaaatactaacgacatgaaaatgcaagtgtcaatggagtagtttattaccttctattggcatcaagttttcctctaaattaatgtatggtatttgctctgtgattgttcatttttttctgctacttttgggtagaaaaaagattcaattgcttggctgtagctttctctcatatatatcaccctaaatataatgaagatcttttagtgtgtatcattttccttttagaaactagtattctcttatttcttactttaatgtacttctatcactgcatttattttgcctgtgcataggagcaattaggatctaaaaaaatatatgggaagataaaagatctaagaacaagtacttgctggaaaattagttggctggacattgataaaataatgcatttataacaattacatgtgtttctgggaacaaggaaaatttctcaaaaaagaatatttcacacatcccttcttttgaatggcctctttgtgaccagccagacctcaggtcttcactctttcttctttgtaaactatgtcatgtggaaagatttcctcagttagtgagcttgtgtctgcaaattgattttgtttgtaatgtattttgatagcaaatcatgctgcatctatatctttttcttgtttgagctgttactacattgtacatggcatgtgggatcaattaaaaatttgttttaaaaata

SEQ ID NO: 4776 - DNA, 846 bp, Homo sapiens
gctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttcca

SEQ ID NO: 4777 - DNA, 770 bp, Homo sapiens
gtggacaccacgtgatcctggggaggcttttgcctcttccgagggctctggctccagggcctccctgttccaggggctaggtgtgccttcctcaatgctgcttttggctatgagggtgacgggcccagggcttcagggccccagatcgcaccttgccatctggggtgtccgtcctttgtcccccacagcaggctgtgtttgcccattttctcctctgccatgggtggagatggatctgaagttgggtgttgaagcctctgaccaaggctgtatcttgttttgaggccctgcccggtttccagggaccacatctggggccaagaggaagaaccgaactgggactaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaa

SEQ ID NO: 4778 - DNA, 12703 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctgcccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggaaccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatgggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttgc

SEQ ID NO: 4779 - DNA, 12919 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctgcccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggaaccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatgggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttgc

SEQ ID NO: 4780 - DNA, 6988 bp, Homo sapiens
ctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctgcccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggaggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctc

SEQ ID NO: 4781 - DNA, 4204 bp, Homo sapiens
cagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagtt

SEQ ID NO: 4782 - DNA, 6817 bp, Homo sapiens
tggcgctcacctgcccggccgcagcagccggctccggcgccgcggttcgcgggtccgggcggaagagcagctccagcttcaaacgtggggtggaaggaggcggcgggggcgacggcggcggcgacggcgggggcgcggcccgcgggcccgggtgttagacctgagggagcctggagatccggccggggcgcgcagggtgcagcggggcgctcaccagccccggggcgcagccggcatggtgtcccaggtgctgcagctgctccggcagggcgtgtgggccgcgctcaccgggggctggtaccacgacccggagcagagcaagttcaccaacagctgccacctctacctgtggctgttcctcctgctgctgcccctggccctgcacctggcttttcctccaaatgcgatcattgtatttttctactgcagtgcagtgactatattcttcacaataatcaaactggtcagttatcgcctacacctcatgtttgacaaaggagaagtaattcagcaaaagccctccagaaaggaagaaaagccaaataaagacaaggaggccaaaggtgaacacataactaatcacagaaatccaagcaataataggcagattcacaatggcaaaaaggaagaggccagtcgaaacctctccacgcctcccctccgctgcagctccagagggcaaagcataacctctcatcactcttctgggccattggagttgtcagcacaggaaactgtagaagatctcaaaggtgtcattctattagaagaccatcccatagcaccagtgtcatctacctcacctggtatcaaagtggaaagcttacctgcgtctcaagcacacatgctggaaaccacgaccaagtcagtaatacctgtaaaaccagttgccacagaaactctcatcaatggtaaaggaaaggaaagaggaggcaaggggcagcctcctttgcgccacagatccgagggtggcttagtggataagggacccttgaagaagttgccccacctgtctttgtctcagtatgacttactagaaacagacgtttctttccagccgtgggggagtgagaattcagtcctgattccagaacctgtcagttgtccccggggctccataagggaacgggtacaaagcaagtcacctcaggacagcctgagcagcagctgccctcaatgtgacaccatcgtggccaagcctgtggaggagccagcagacacatcctgtcaggtagatacctcctgccagggggacctgcccttgcaccaggaagtggactcctcagatagtgaggtagctgttactctcatcgatacttctcaacccggagacccactgagtctacatgagcccataaaaattgttatcacgatgagcagtaccccaaactccatgacagatttggaaagctccctccacctgagggtggttggcacagagaagaccagtgtaaagtctgacgctgagcccactaacccaggggcggccggttctccaaatgccgagcagatctcaattcctgtaatcaccctggacctgcctgagggtgggggaggaggtgttccctgtcccgaaggcaatggaagtgaaaggactccagagagactgaagacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagctcggggacctgcttcacaagttacagttcgtcctgacatatgtggctccttggcagatggcttggggttcttcgtttcacgtgtttgctcagctctttgccattcctcattctgccatgcttttctttcagacgattgccacatcaatcttttctaccccattgagcccatttcttgggagtgtcattttcatcacatcatatgtcaggccagtgaaattctgggagaaaaactacaatacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcggcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttg

SEQ ID NO: 4783 - DNA, 5348 bp, Homo sapiens
cgaatatatcagatttaaccatatgaaattgccattttgtaggtgataataaacagttgactatcgtcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagagctttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccaggttggagtgcagtggtgcaatctcggctcactgcgacctcggcctcctggattcaagttcagcctcccaagtagctgagattataggagtgtgccaccacacatggctaatctttttgtatttttagtagagatggagtttcacactgtttgccagactggtaccaagctcctgacttcaaatgatctgcctgcctcagcctccctaagtgttgggattacaggcatgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcgggtaaggggctgggcagggctcaccaggacaggctgggatggtggcacgggctcctggcctgagcgtggcacctgccttgcgttcccacccttctgcctgcagaaccccatccccttctctatggggctcccagagtgacaaaggacagtgattagacacgaagtggcttagctgctcttgaaagcagacaagatacagagcagatatcctgtaaacgataatgcccaggcaggcactgaaaggagtcaccggatacagaggttctgcagaactgtggccatctgccctacaccggggcatgacggagaatgccctccacccattcacacagcaggactcttctcacatgattctggcctgagggagaggaaaggacacctgtcaatgctggagttagagcttcactgcttctcagccaatcgatttgactttaaagctgctgagatggcccactgcttttaggtatttaaatactagacaaggagagttctaaggacttcacccaaataagctgttacttgtccagaatcccaaaccagctgagatgaaatgaatacttgagcttcttcagtgagaaaaaagtaaataaatacccagcagtgctcctatgtgacctggtagacagggaaaatcgatggtgtcaaggcaaaaatgggtcaggtttggagagttcccccactccttttgagtgttcaggttttccttaccatggctcatgctttccatcaagcaccagagttgcagtggcttggcctctggttctgggtgaggttatttgcaggtggagacggggggctgcacctgaacatttctagtgtcaccctccctctccttcatgggaaacagctctccagggaagtaccttcctgccaggggaagccaaggctgggccggccgccctacaaggagccacaggattgcagccatgggtgccacctttcatggaaggggagatttatgggctttcctggaacccccaggctgtcctggccaagaggaaagaggtggttacttcaggagtttgaccttagttagataactaaaagaatacatttcccctcccttttctttatttcctcaataaaaatgtacaaagtatcacccttctccatgccccaatctgtgttaaagtcacaatctatgggtgtagttctgggattctgtcaaattctccttcctgctctccaaaatggacaattgtcgtagggaccacatgcccccagaatacaatggcctctgtgttctactggggtcaagcctgctagaactcagcattcatgacaggggctaagtgtgcatgaagtgacactgactacagctagaaagccaggcgcacaaatgccccttccccccagggccgctctttccagcgcagtcatccagaaaggcccacgtgcagagcccctgtgtctcagatgctgcttcagttgcccgtcctgtcctcagaggccactgtgctggccctctatcatttgacctgactttagaacctgacctcaaggatatggcagcgctagcctttagctcccacagcacggatgggggtgatgccagttagaagtgggtagtgaacgtttgctgagctgttcactgtttctctcttctctttggaagcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttg

SEQ ID NO: 4784 - DNA, 3199 bp, Homo sapiens
tggcgctcacctgcccggccgcagcagccggctccggcgccgcggttcgcgggtccgggcggaagagcagctccagcttcaaacgtggggtggaaggaggcggcgggggcgacggcggcggcgacggcgggggcgcggcccgcgggcccgggtgttagacctgagggagcctggagatccggccggggcgcgcagggtgcagcggggcgctcaccagccccggggcgcagccggcatggtgtcccaggtgctgcagctgctccggcagggcgtgtgggccgcgctcaccgggggctggtaccacgacccggagcagagcaagttcaccaacagctgccacctctacctgtggctgttcctcctgctgctgcccctggccctgcacctggcttttcctccaaatgcgatcattgtatttttctactgcagtgcagtgactatattcttcacaataatcaaactggtcagttatcgcctacacctcatgtttgacaaaggagaagtaattcagcaaaagccctccagaaaggaagaaaagccaaataaagacaaggaggccaaaggtgaacacataactaatcacagaaatccaagcaataataggcagattcacaatggcaaaaaggaagaggccagtcgaaacctctccacgcctcccctccgctgcagctccagagggcaaagcataacctctcatcactcttctgggccattggagttgtcagcacaggaaactgtagaagatctcaaaggtgtcattctattagaagaccatcccatagcaccagtgtcatctacctcacctggtatcaaagtggaaagcttacctgcgtctcaagcacacatgctggaaaccacgaccaagtcagtaatacctgtaaaaccagttgccacagaaactctcatcaatggtaaaggaaaggaaagaggaggcaaggggcagcctcctttgcgccacagatccgagggtggcttagtggataagggacccttgaagaagttgccccacctgtctttgtctcagtatgacttactagaaacagacgtttctttccagccgtgggggagtgagaattcagtcctgattccagaacctgtcagttgtccccggggctccataagggaacgggtacaaagcaagtcacctcaggacagcctgagcagcagctgccctcaatgtgacaccatcgtggccaagcctgtggaggagccagcagacacatcctgtcaggtagatacctcctgccagggggacctgcccttgcaccaggaagtggactcctcagatagtgaggtagctgttactctcatcgatacttctcaacccggagacccactgagtctacatgagcccataaaaattgttatcacgatgagcagtaccccaaactccatgacagatttggaaagctccctccacctgagggtggttggcacagagaagaccagtgtaaagtctgacgctgagcccactaacccaggggcggccggttctccaaatgccgagcagatctcaattcctgtaatcaccctggacctgcctgagggtgggggaggaggtgttccctgtcccgaaggcaatggaagtgaaaggactccagagagactgaagacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagggaaaattatgaacagccacaaagacttttttacttctgaaaaaaaaaaggacaaaataatttcagcaatttcaagtgtcattttcctgaagtcctggtaa

SEQ ID NO: 4785 - DNA, 7105 bp, Homo sapiens
ggcgcatgcgccactgcaggctggcggttcgcggctccttcttccggcctcctccttaggccggcaccagcagaagccgggcgagcgcggagccccaagcaagtgacctgcgaccccgaaagtggaccccagatcctggggttctccctggtccggagactagggagctgtcgcctgcaccccgggagcacccaccccacgaccacctctggatgccgccgacgggtacccggcccgtgccccgcgcctgcctgccggctcggcccctcggagcaattctgggccaggagtggggacccggaccccgcccctgatgcagccccacccccgcgtccgggccttgcaccactgactgtcccggccggccccgccccctgctcgcaccctcgcgcggccgagcccccctcccccgctgggggaggccatggcgtgagcgtgaggccgggccccggggccctcaggcgccagacggggcatgggccgggggccgcccccatgagggtcccgggagggggggcgcgggcagcagcggcggggccatggggtcgcaggtgttgcagatcctgcgccagggggtgtgggcctcgctcaccggcggttggttcttcgacccgcaccagagcaccttctccaactgcttccacctctatgtgtggatcttcctgctcatctttcccttcttactgtacatggtcctgcctcccagcttgatggtggccggcgtgtactgcctcgtggtggctgtcatctttgctactatcaagactgtcaattatcggcttcatgccatgtttgaccagggcgagatcgtggagaagcgcagctctaccatgggggagctggaggaagagcctgcccagggggacagcaatccacccagggaccccggagtggagatgacagtgttccggaaagtcagttccacacccccggtgcgctgcagctcccagcactctgtgtttggcttcaaccaggtctcggagctgctgccccgaatggaggactctgggccccttagagacatcaaggagctggtgcgggagcagggcagcaacaatgtgatcgtgacttctgccgaccgagagatgctgaagctcagctcgcaggagaaactgattggagaccttccccagacgcctccaggggctgtcccagacccctctcttgccagtacagactcttcagagccttctcccctggctggagatggagcgccctggagtgggagcagcatggctgacactcccatgagccccctgctgaaggggagcctcagccaggagctgagcaagagcttcctgaccctgacccagcctgaccgggccctggtgaggaccagcagtcgacgggaacaacgcaggggggcaggtggctatcagccccttgaccggcggggctcaggggagcccacgccccagaaagccggctcctcagactcctgcttcagcggcactgacagggagacattgagcagcttcaagagtgagaagaccaactccacccatctggacagccccccaggggggccagcccctgagggcagcgacacagacccaccctctgaggctgagctgcctgcctcaccagacgccggggtcccctcagatgacacgctgcgttcctttgacacggtcattggagcagggacgccaccgggcctggctgagccgctcctggtcgtgcggcccaaggacttggccctgctacggcctagcaaacggcagccacccctgcgaagacactctccacctggccgtgcccctcgacggcccctgcttgaaggtgggggcttctttgaggatgaagacactagtgagggcagtgaactgagcccggcctccagtctccgatcgcagcgccgctacagtactgacagctcctcttctacttcctgctactcccctgagagctcccggggtgcagcagggggaccccggaagcggagggccccccatggggctgaggagggaactgctgtgccccccaagcggccatatgggacccagcggacgcctagtaccgccagcgctaaaacacatgcccgtgtgctgagcatggatggggctgggggtgatgttctgaggcccccactggctggctgcaaggcagagctggaggcccaggttggggtggagcaggctgctagtgagcctgttgtgctgcctgctgaggcgcgaaggggacccgctgccaaccagcccggctggcggggggagctgcaggaggaaggtgctgtggggggagcggccgaggagactggcaggcgggaccgctcaagcagtgtgaggcggacccaggccattcggagacgccacaatgcaggcagcaaccccacccctccagcctctgtcatgggctcgccgcccagcagcctgcaggaagctcagcggggccgggctgcctcccactcccgggcgctgacgctgccctctgcgctgcatttcgcctcttcactgttgctcacccgggccggtgccaatgtgcatgaggcctgcacctttgatgacacttctgagggtgctgtgcactatttctacgatgagagcggtgtgcggcgttcctacacctttggcctggctggaggcggctacgagaaccctgtagggcagcaaggggagcagacagctaatggagcctgggaccgacactcgcattcctccagcttccactcggctgatgtccctgaggctacaggcggcctgaacctgctgcagccgaggcctgtggttctgcagggcatgcaggtgcgccgggtgcccctggagatcccggaggagcagacactgatggaagaagcgccaccccgggcccagcatagttacaagtactggcttctccctggccgctggacctctgtgcgctatgagcggcttgccctgctggctctgctggaccggacgcggggagtgctggagaacatcttcggcgtgggcctgagcagccttgtggccttcctgggctacctgctgctgctcaagggcttcttcactgacatctgggtcttccagttctgcctggtcatcgcctcctgccagtactccttgctgaagagcgtgcagcctgatgcggcgtcccccatgcacggccacaactgggtgatcgcgtacagccgtcctgtctacttctgcatctgctgtctgctcatctggctgctggacgccctgggctcagctcagcccttcccacctgtctccctctacggcctcacgctcttctctgcctccttcttcttctgtgcccgagacgtggccactgtgttcaccctgtgcttccccttcgtcttcctcctgggcctcctgccccaggtcaacacctgcctcatgtacctgctggagcaaatagatatgcacggcttcgggggcacagctgccaccagcccgctcacggcagtcttcagcctctcccgcagcctgctggctgctgccctgctctacggtttctgccttggggccatcaagactccgtggccagagcagcacgtccctgtcctcttctcagtcttctgtggcctcctggtggcactgtcctaccacctgagccggcagagcagcgaccccaccgtgctctggtctctgatccggagcaagctgttccctgagctggaggagcgcagcttggagacagcccgggccgagcccccggaccccttgccggacaagatgcgccagtcggtgcgtgaggtcttgcactccgacctggtgatgtgtgtggtgatcgccgtgctcaccttcgccatcagcgccagcaccgtctttattgccctgaagtcggtgctgggtttcgtgttgtacgcactggctggggccgtgggcttcttcacacattacctgctgccacaactccgcaaacagctgccctggttctgcctgtcacagcccgtgctgaagccgctggagtacagccagtatgaagtgcgcggtgccgcccaggtgatgtggtttgagaagctgtatgctggcctgcagtgcgtagagaagtacctcatctaccccgccgtggtgctcaacgccctcacggtggacgcccacacagtcgtcagccacccggacaagtactgcttctactgccgggcgctgctgatgaccgtggctgggctgaagctgctgcgctcagccttctgctgccccccacagcagtacctgacgttggccttcaccgtcctgctcttccactttgactacccgcgcctctcccagggctttctgcttgactacttcctcatgtccctgctttgcagcaagctgtgggacttgctgtacaagctgcgtttcgtgctgacctacatcgcgccctggcagatcacctggggctcggctttccacgcttttgcccagccgtttgccgtgccacactcggccatgctgttcgtccaggccctgctctcggggctcttctccacgcctctcaacccactgctaggcagtgccgtcttcatcatgtcctacgctcggcccctcaagttctgggagcgcgactacaacactaaacgtgtggatcattccaacacccgcctggtcacacagctggacaggaaccctggcgctgatgacaacaacctcaactccatcttctatgagcacttgacacgttcgctgcagcacacactgtgtggggacctggtgctgggccgctggggcaactatggccctggtgactgcttcgtcctggcctctgactacctcaacgccctggtgcacctcatcgaggttggcaatggcctcgtcaccttccagctgcgtggccttgagttccggggcacttactgccagcagcgcgaggtggaggctatcaccgagggtgtggaggaggacgagggctgttgctgctgtgaacctggccacctgccacgggtcctgtccttcaatgctgcctttgggcagcgctggctggcttgggaggtaacagccagcaagtacgtgctggagggctatagcattagtgacaataatgctgcctccatgctgcaggttttcgacctccgcaagatcctcatcacctactatgtcaagagcatcatctactacgtgagccgctcaccaaagctggaggtgtggctcagccatgagggcatcacggcagccctgaggcctgtgcgggtgcccggctatgccgactcggatcccaccttctcgctgagtgtggatgaggactatgacctccgcctgtctggcctctcgctgccctccttttgtgctgtgcacctcgagtggatccagtactgcgcctcccggcgcagccagcccgtggaccaggattggaactccccgctggtcacgctgtgttttggcctgtgtgtgctgggccgccgggccctggggacagcctctcacagcatgtctgcaagcctggagcccttcctctacggcctgcacgccctgttcaagggggattttcgcatcacctccccacgtgacgagtgggtctttgccgacatggacctgcttcaccgcgttgtggcgcctggggttcgcatggccctcaagcttcaccaggaccacttcacgtccccagatgaatatgaggagccagcagccctatacgatgccattgcggccaacgaggagcggctggtcatctcacatgagggtgacccagcatggcgcagcgccatcctcagcaacacgccctccctgctggcgctgcgccatgtcctggatgatgcctccgacgagtacaagatcatcatgctcaaccggcgccacctcagcttccgagtcatcaaggtgaaccgggagtgcgtgcgcggcctgtgggccgggcagcagcaggagctggtgttcctgcgcaaccgcaaccccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggcttcacaagggctgtggcgccggctgcaatagtggcgggaacgtggatgattcagactgtagtgggggcggtggcctgacctccctcagcaataacccccccgtggcacaccccacacctgagaacacggcaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttg

SEQ ID NO: 4786 - DNA, 2195 bp, Homo sapiens
agtagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggttaaggaaacgatccatgcaagagaggcccaatctcaactgtagactgtgtcccagtaagagagtcacagcttcaggtgtttgctgaatccaggtctgagatcacaatcccacctgaggacaggatccgcatatgagagtcgcacattggtataattgatttgtggtagagctgagattagaatccagattcctagtctagtatccttcccactgtaccacattatctcttttcagaggggaaaaaggagcagctcttaagaaacagaatactaagggcccccattactgtgtggccctgggcatcctcagtttcctcatttggtaaatggggataatggtaccgacctcttaggcttggtgtgaggatgaaatgagatagggaatataaagcaagcagatagtggctggcacatagtacatgcaatatgtttgaaactagttaaggaattataaaaacaaatgagttcttccttctgctcaaaaatattgaatttcttgtccttgtgctctgtgaaacattgaacagccccatttagagaaacaaattctctgccctcatagaatcctaattgtttctgtatgtgtctggtgttttgcacatgcaaaaaaaaaaaaaaaa

SEQ ID NO: 4787 - DNA, 1927 bp, Homo sapiens
ggttccagtagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataaggaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgc

SEQ ID NO: 4788 - DNA, 1440 bp, Homo sapiens
atggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttat

SEQ ID NO: 4789 - DNA, 894 bp, Homo sapiens
gttccagtagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccaggtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgaggg

SEQ ID NO: 4790 - DNA, 6734 bp, Homo sapiens
cactgcgccccaccttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatgggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagttgtccacataagcagcttcatctttaccttgccagagttgacaattatgggatactctagtctacttatacttgtgttcccatctgtctgccatcctctgaaggccgggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagagagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagttgggaggattgtttgagcctaggagagggaggttgcagtgagccgtgattgcaccactgcactccagcctgggcaacagagcaagaccctgtcttggagaaaccagaattttggaagagcaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatacaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaaaaaaaaaaaaaaaccaaaaaaactgtccagctgtggactttcaggattcaggactgctggggatcaagcccaaggatgtttttcagagctctgtgatttaagatgctcgaaaagagtgtccaagaggagtaaaggtcatgacagaatttactcccaggacaatctaagttctgccacaagtacccgtggtgtctgttcccacaacaatggccctttcacaagctcttgcctcacaacccctgcagaagtccttcaacaaaactaataatagactagtgaaacctactcctcacatgggtaagagttgcagtgggcaggtgaccctcctccctgcccccatcctttgcttcctcaagctccctgccaacctctggatacatcaatgggaaggaaaccagggaagcatagacctatagtacaacaggggtgtagtgaccactggacctgatgaagcgaatctgcctgaaatttaatacgcctttttatttcccttctgtgttaaatcaaatgatctgttctgcactgagccaagcaagttacttttaaaactggtggcaccactcatttgggacttggagactgcttttatccagaacctgttaagagaacaggggatttaaatacaaaggaatatgaaggtggtgtgccttaaagacagtctaaaattaggttttagtttgttacattattttgaaatattaaacatgaaaatgttaaatcaggatgtgtgagttttaagatgttgaacactgtcctacatcagtgaggagggaggcaataaagtaatttcagagtaaaacagattgaggatgaaaccaagacagaagtgatgatttggctttttatgatttttgctgtggaaatggcagtcgtgtgacttttcacttgcagtttaaatgaaagggtgaagagaagcctacctgccctaatggctcagggctatatccacctcccggataaccctggcccttgggactccatcatctccttgaagtagcactgagaatccaagaagaggctccgctgctttttgcacatgttactgagttacatctcaggaagatttttaagcacgaggaaggaaaatacaggcctggccaagcagggtccccttttcggtatcatctttgttcctaataagcaatcaaggggggtgggtgtgttggctggtaaaggaactactaagattcagaagcttgtagtcttcattattttgttttacaggttaaaataaaccacttgactggg

SEQ ID NO: 4791 - DNA, 866 bp, Homo sapiens
aaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaag

SEQ ID NO: 4792 - DNA, 2472 bp, Homo sapiens
aagcacatccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatga

SEQ ID NO: 4793 - DNA, 2385 bp, Homo sapiens
agaaatggcggctgcggcggctcgagtggtgttgtcatccgcggcgcggcggcggctctggggtttcagcgagagtcttctaatccgaggcgctgcgggacgggtgagcttccctccaggccggtcctgtcctcgagatctcgccagacccggcgcagcgcacctgagagtcggcgccacagatccgaacagtgggtcgggcagggcctcctcgacccggacccgccgggcgccaggcggcctggggctgctgaactggccgggggtgactggcttgtggccacccgccaggagacctgctagtgacgtgtgggatgaccctggttttcggctcctcccgccagctactgaggagtgcatgtttgaccactaaaaacgtagtgcttgcaaattggggaaaactaaaaagtgaaatgggtaccgctccagagttctatttttgcctaagactgaacttcgtcctcagctgggcttcccgcgaacctggacatcaatgaatcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggatataatcacagaagtgaacttcatgaatggaaatggaacaagttattttccaaaaggcaaactatttcatactcctacgtgaacatccttttaccacagcctcagccacagtacgtctaattatttaaaatttgtgattatcgctggtggtcaacaatttttttgtttttcatcctttaactggaaaaaggaggggctgtctcagtttttcttctgactctgtgtgtcacttacaattaataatgctagctgttaacatctacatagcagttgacatgtgccaggcctgtttaccagttaatcttctccatgatcctatgaggaaagtgctattgctgtctccatttcatagatgaggaaaatgaggcacagaggagacgttatgtagccactaccactgcaacttgctcaaacttccggccaagtcggctctagtccagacagcctgactcctcagcctgcgtctgtatgctgcctctcctaattcattatgtttattaataatttttccccgttttgttaacacttatgtttcaaaaacagtcatctttatttacattgactgatcatttcttttgt

SEQ ID NO: 4794 - DNA, 2692 bp, Homo sapiens
atcttctcctgcagcaggcccatgcgcgtgttggcgccctcgtcctgagggctcagcgccagcgcctgctggtagtccgcctcggcaaaggccaggttgcccagctggaagaagcaatctagggtccggaggcggggatgctttggaacacgtggctggtcccaaagatgtgctgcaggatccctttgggggctggaatcacccatggctttgggatgtcccgtgaggggccctggtcaaccttcagggcatcctagaaccgaaggacagcaagctggagcaggcccccgagacgacccccacccactgacacactccccagcattctgcagggagggaggagaggcggaaatgaggcctggaaggaggcactcccactcggggttccggtggcgctcccagccccattccccttagggacgctccaacctgtccctctgcagtcctgcccttctccctctcctgtggtcaaggtcagggatcagggtcctcatgcttacaacaccgtctgttctcccccagggccttcccagctcccacttccggctactgacaccccaagctttgatgtctccagctcaggcctggtcccaagtctcaggccttgggggtcctacagtcccttgggtaaccttcaggaccctcactccagcaggccacactgagcacctcacctgacttctgccccaggttctcccattttggtgaggtcaccttccccaccagctacccaagccagagacctctgtccaagcagccgccgagccttacaaggatctttcacatgcctggttcttggcatggcggccagggccttccctgagtcggactgctgcccctgcctctcccggccttcaccctttcctgcgaacccagcctcggtctctctgcctggccctctgcctttgcgttagtcttctcccaagcccgcacctcgtccgaatctgtcatgaggccccttccaggaggaccccgaggcctctgccaactacctcgcggccctggccctgacgttgctaggcaccatcaccaggacgcccacaggccccacccctctggccacgcccccgggaaccaagctttttgagccggagggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactggaccagtccatttctggagtaggttcttctctctgtgtcctacttgggacgtaggggaacttcaggaagactaaacttttcaagcctttttagagaaccaggggcacgcatctgtaagattaaagatgctggcttggaggccgggtgcagtggctcacacctataatcccagcactttgggaggccgaggctgggggattgcttgacgtcaggagttcgagaccagcctggccaacatggtgaaaccctgtctctactaaaaatacaaaaagtagccaggcatggtggtgcatgcctgtaatccctgctacttgggagactgaggcaggagaatcacttgaacctgggaggcggaggttgctgtgagctgagattgtggcactgcactccagtctgggtgacagagtgagactctgtctcaaaaaaaaaaaaaaa

SEQ ID NO: 4795 - DNA, 814 bp, Homo sapiens
ggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtg

SEQ ID NO: 4796 - DNA, 6341 bp, Homo sapiens
atgcagaccctgggcagcttctttgggtccctgcctggcttcagctctgcccggaacctggtggccaacgcacatagctcggcgagagcccggccggccgctgaccccacaggagcgcctgctgccgaggctgcccaaccacaggctcaggtggctgcccacccagagcagacggccccatggacggagaaggagctgcaaccttcggaaaagcagatggtgtccggggccaaagacctggtgtgttccaagatgtccagggccaaggatgccgtgtcctccggggtggccagcgtggtggacgtggctaagggagtggtccagggaggcctggacaccactcggtctgcacttacgggcaccaaggaggtggtgtccagcggggtcacaggggccatggacatggctaagggggccgtccaagggggtctggacacctcgaaggctgtcctcaccggcaccaaggacacggtgtccactgggctcacgggggcagtgaatgtggccaaagggaccgtacaggccggtgtggacaccaccaagactgtgctgaccggcaccaaagacacagtgactactggggtcatgggggcagtgaacttggccaaagggactgtccagactggcgtggaaacctccaaggctgtgctgaccggcaccaaagatgctgtgtccactgggctcacaggggcagtgaatgtggccagaggaagcattcagaccggtgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccaccaagactgtcctaactggcaccaagaacactgtctgcagtggggtgaccggtgccgtgaacttggccaaagaggccatccaggggggcctggataccaccaagtctatggtcatgggtacgaaagacacgatgtccactgggctcacaggggcagcgaatgtggccaagggggccatgcaaactgggctgaacacaacccaaaatatcgcaacaggtacaaaggacaccgtctgcagtggggtgactggtgccatgaatttggccagaggaaccatccagacaggcgtggacaccaccaagatcgttctaactggtaccaaggacactgtctgcagtggggtcaccggtgctgcgaatgtggccaaaggggccgtccagggcggcctggacactacaaagtctgtcctgactggcactaaagatgctgtgtccactgggctcacaggggctgtgaacgtggccaaagggaccgtccagaccggcgtagacaccaccaagactgtcctaaccggcaccaaggacaccgtctgcagtggggtgaccagtgctgtgaacgtggccaaaggggccgtccaggggggcctggacaccaccaagtctgtggtcataggtacaaaagacacgatgtccactgggctcacgggggcagcgaatgtggccaagggggctgtccagacaggtgtagacacagccaagaccgtgctgaccggcaccaaggacacagtgactactgggctcgtgggggcagtgaatgtcgccaaagggaccgtccagacaggcatggacaccaccaaaactgtcctaaccggtaccaaggacaccatctacagtggggtcaccagtgccgtgaacgtggccaagggggctgtgcaaactgggctgaaaacgacccaaaatatcgcgacaggtacaaagaacacctttggcagtggggtgaccagtgctgtgaatgtggccaaaggggctgcccagacaggtgtagacacggccaagaccgtgctgaccggcaccaaggacacagtcactactgggctcatgggggcagtgaatgtcgccaaagggactgtccagaccagtgtggacaccaccaagactgtcctaactggtaccaaggacaccgtctgcagtggggtgaccggtgctgcgaatgtggccaaaggggccatccaagggggcctggacactacaaagtctgtcctgactggcactaaagatgctgtgtccactgggctcacaggggctgtgaagttggccaaagggactgtccagaccggcatggacaccaccaagactgtgttaactggtaccaaggatgctgtgtgcagtggggtgaccggtgctgcgaatgtggccaagggggccgtccagatgggtgtagacacggccaagaccgtgctgaccggtaccaaggacactgtctgcagtggggtcaccggtgctgcgaacgtggccaagggtgctgtgcaaactgggctgaaaacgacccaaaatatcgcaacaggtacaaagaacacccttggcagtggggtgaccggtgctgcgaaagtggccaaaggggccgtccaggggggcctggacactacaaagtctgtcctgactggcactaaagatgccgtgtccactgggctcacaggggctgtgaacttggccaaagggactgtccagaccggcgtggacaccagcaagactgtcctgaccggtaccaaggacaccgtctgcagtggagtcactggtgccgtaaatgtggccaaagggaccgtccagacaggtgtggacacagccaagacggtgctgagtggcgctaaggatgcagtgactactggagtcacgggggcagtgaatgtggccaaaggaaccgtgcagaccggcgtggacgcctccaaggctgtgcttatgggtaccaaggacactgtcttcagtggggttaccggtgccatgagcatggccaaaggggccgtccaggggggcctggacaccaccaagacagtgctgaccggaaccaaagacgcagtgtccgctgggctcatggggtcagggaacgtggcgacaggggccacccacactggcctcagcaccttccagaactggttacctagtacccccgccacctcctggggtggactcaccagttccaggaccacagacaatggtggggagcagactgccctgagcccccaagaggccccgttctctggcatctccacgcccccggatgtgctcagtgtaggcccggagcctgcctgggaagccgcagccactaccaagggccttgcgactgacgtggcgacgttcacccaaggggccgccccaggcagggaggacacggggcttttggccaccacacacggccccgaagaagccccacgcttggcaatgctgcagaatgagttggaggggctgggggacatcttccaccccatgaatgcggaggagcaagctcagctggctgcctcccagcctgggccaaaggtgctgtcggcggaacaggggagctacttcgttcgtttaggtgacctgggtcccagcttccgccagcgggcatttgaacacgcggtgagccacctgcagcacggccagttccaagccagggacactctggcccagctccaggactgcttcaggctgattgaaaaggcccagcaggctccagaagggcagccacgtctggaccagggctcaggtgccagtgcggaggacgctgctgtccaggaggagcgggatgccggggttctgtccagggtctgcggccttctccggcagctgcacacggcctacagtggcctggtctccagcctccagggcctgcccgccgagctccagcagccagtggggcgggcgcggcacagcctctgtgagctctatggcatcgtggcctcagctggctctgtagaggagctgcccgcagagcggctggtgcagagccgcgagggtgtgcaccaggcttggcaggggttagagcagctgctggagggcctacagcacaatcccccgctcagctggctggtagggcccttcgccttgcccgctggcgggcagtagctgtaggagcctgcaggcccggcgcggggtcgccctgctctgtccagggaggagctgcctcagaactttctccccgcccccaaacctggatcggttccctaaagccctagacctttggggctgcagctggctgagcgccgaggggctgcggaggcagtgaccttcttaactgagccaccccacgccctgctccgggcctgcctgcatctcccacctcctccccagcgctgcctgcccctctcggagcctggggtcactcagaccaccagccaagagccttcccttgaagtccccaagcaagcactgcaattaggaaagagaaaaagcagcgtgcccagcctggaagggcatctgtttgccccgctagcaacccttttatatctagcagggctcttccagtcctgcagcacgggcccccagctatcagcggtgcaggcagtgctgtggcatcccaggctccgggcagctccgttctcatgctgaaagtgggtctccggccttagcacacacaccttgagggtcttaagaaccacattccctcatagtagaaagtactagaaaaagcgacactgccatcatcatcccaaggcaggctgctactgcctttgctgacccccggggtggcctcacggtggggacaaagctgccaggagccacagcagccacagctggggctttgcaccagcctggcttgagactgagcagtttgcagggggtggggggtgcaaaaaacaagcaaacaggctgctgctgcctccagctgcccaccacaggcctgccccaggcacctggggctctgaggcccctggggaggctgggcccagcagctgcccctggagaacacagacaaaggacttccccgcagggaactgtgccctatggagggatcagacagggctgggaacagccacagaggctgcgtgcctatggcacagcccttcctccgccgcacactccccctgggtcctcaggcccacccaagcgccgggctgcagaggaagcggggctggggaggctgcaggcatcagagacactggtggtggcggacccggccgccgggccccgtgctctcaggctagcccaggtcgtggaggctggcaggctcaggtcgggtgtgagacgtgccgtggctgcgctcagtccagcggggaggagccgttcagcccggcctccccaggaagccatatccccactcacccggtaagagaaccttgtcgtcccctttccatgctctcctaggacacgagcccaggaaccccagacccagggggaggaagggtggaggggccccaggggtcaccgtgtgcaccaggggccgtgaggggccggggcattcagctcagctctgaaccggggaagctggcacggcaaggactgcctcaggtgacgggccgtgagaggggacgggtcaggagccttcccaagccttctcctcagcccgacacccatggccatcggaggctaggatgccagacacagccatttgcagaaatcaggcacagtgactgcagctcacgtccagccaaccaagcatggggccgcagctcaggaagtcccttcccgccacaccacagcctaattcttactgggacggaggcaactcggctacgctgggcaggacgacaaacacgagacgccactgtggaatgagcaacttcggagcacggggtgacttgcttgggaccgtgcccacgtgacagccccttatgcagaggaggaaagagaagccccgagtgggaggggaacctgtccaaagtcacacggtgtgtgggtgacacagctggggtgagtcgaggctggcccctgaggcccatgctccctgaacgctggagaccactgtcggctagcagcggctctcagggaaggcctggtctccaccctcccagcctagcctcgcggaccctcgtcctccccacatcggacctgctcacctgcctggaccctgggctgccagatgcaggaagcatcaaaccccccagcctcgtgggtgcggggcagggcgcaggcagcacagcttagatgccctggtttgtccctcttgtctcctgggaagagcttgctcccgcccagctctcctgccactggcctttcagggttgggctgggcccagagtgccttttagtcgcttctcacggtggcctgatggctcaacccagtcccaaacgggcccagtgacactgccgcctgcgccccagctcaggcccccactgcaccagcaatgctagaaaaccaagccaataaaagtgatttcttttttcattaaaaaa

SEQ ID NO: 4797 - DNA, 1740 bp, Homo sapiens
ttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtagggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcga

SEQ ID NO: 4798 - DNA, 667 bp, Homo sapiens
ccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattgaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcga

SEQ ID NO: 4799 - DNA, 1632 bp, Homo sapiens
aactccggctacgggggcccgaacggaccgtgaggcgcagatttgagccgctgttgagatgattcctttccgttcgcggaagagatggggaaactgagggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcg

SEQ ID NO: 4800 - DNA, 2601 bp, Homo sapiens
ctcccttcaaacgtggcgtcgtgggttgtttgcgcctcgcctggggtcagcgagcaaggacgggcgcgggcggggatactcaaagccaacagctggagtcagcccttgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctgggggggaaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggttgagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacacttaagtagattttaagaataaatgtttctggaaaagaactatgttatgattttgtagaaatgtaaagattacttgaggtgtttaaaataaatttttcattcagacta

SEQ ID NO: 4801 - DNA, 1588 bp, Homo sapiens
tagagcgcctctcttccgccaggcatcccagaggtcctggtggtttcatttccgggtgcggcttctgtcataaagcggagacctcccttcaaacgtggcgtcgtgggttgtttgcgcctcgcctggggtcagcgagcaaggacgggcgcgggcggggatactcaaagccaacagctggagtcagcccttgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccaaaaaaaaaaaaaaagaaagaaagaaagaaaaagaaagaaagaaagaaggaaagaagg

SEQ ID NO: 4802 - DNA, 957 bp, Homo sapiens
gggctccgcgcccggccagcctgaggtggggtcggtgcccccggcggcacggcgctggggaggcgatggcgccggccgcgtccaggctgcgggccgaagccgggctcggggcgctgccgcggcgggcgctcgcccagtacctgctcttcctgcggctctacccggtgctcaccaaggcggccaccagtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgccccagaaacttaaaatttagtcgaggcagtttcaattgttactgtggaccgaattaggatcacaataaacgataatgcaggttcttcaatggtga

SEQ ID NO: 4803 - DNA, 1050 bp, Homo sapiens
aggttccacccaaggacccaacaggggccccgcgcgcccggggaagccacggcaaggggagcgggtccgcaggcgcgggtgaagacagggcgaggggagcggtggcattttgtcagcacttgggaacttcctggcccagatgattgagaagaagcggaaaaaagaaaactctagaagtctggatgtcggtgggcctctgagatatgccgtttacgggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagttt

SEQ ID NO: 4804 - DNA, 989 bp, Homo sapiens
atagacgccacgagtcggcggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtctatggagccaaaatccgggcccctcacgcgctggtcatgacctttctcttccggaatggcagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactg

SEQ ID NO: 4805 - DNA, 1732 bp, Homo sapiens
ggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtctatggagccaaaatccgggcccctcacgcgctggtcatgacctttctcttccggaatggcagcctccaggagaagctgtgggccatactgcaggccacatatatccactcctggaacctggcacggtttgtgttcacctacaagggtctccgtgccctgcagtcctacatacaaggcaagacctacccagcacacgcattcctggcggccttcctcgggggtatcctggtgtttggagaaaacaataacatcaacagccagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactggagaagttctagattcccactgtccaatagaaacacgtgagccatatatgtaattaaaatgtttctagtagctgcattacaaaaaagaagcctgggcactgtggctcactcctgtaatctcagaactttgggaggctgaggcaggtggatcacttgagctcaggagcttgagaccagcctgggcaacatggtgaaacccagtttctacaaaaaatacaaaaaattagccgggttccatcacctgtggttccagctgaggtgggaggatcacttgagcctatgaggtcgaggctacagtgagcaaagatcacgccactgcactccagcctgggcgacagtgagaccctgtctcaccaaagaaaaaaaaaaggtgagattaatcttcactatatattttaacacaaatttctaaaagttatttcaacatataattaacatcattagatattttgtactcttttttgtattaagtattcaaaattgggtgtatattttgccacccacattttcaggacccagtagccacatgtggctagtggctgctgtgacgggcaacacagata

SEQ ID NO: 4806 - DNA, 1860 bp, Homo sapiens
actctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccctgctgtcacttacatctataactgggcctacggctttgggtgggcagccacgattatcctgattggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcattttagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattct

SEQ ID NO: 4807 - DNA, 2009 bp, Homo sapiens
ggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccctgctgtcacttacatctataactgggcctacggctttgggtgggcagccacgattatcctgattggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcattttagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaa

SEQ ID NO: 4808 - DNA, 2385 bp, Homo sapiens
atagtgaggctgagtcacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcattaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgttacccattctaagaaaacttttcattctgcagttccttcaacaaatatttttgagcaactcctaagggccagccattgtaggtgatgggcattagcagtggtcaagagagactgtaatttggatgtattgttttcagacctaaacacaggttaacaaagatgaaaatacaaccaaataaactggcacagtataaacacatttgtttgtttaaggaggtctcaagagggtggggaaggaggatattattagaattaatcaacctatcgactgagtagaagtgatattgcctgttaaactccctccccatcccagaaggcacagtctgagaataaatgaattaaaaaaa

SEQ ID NO: 4809 - DNA, 1135 bp, Homo sapiens
atgcatggaattggtccttctggcagttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagac

SEQ ID NO: 4810 - DNA, 1070 bp, Homo sapiens
cgggcttcccctccccggtccgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagacttgg

SEQ ID NO: 4811 - DNA, 1521 bp, Homo sapiens
cgggcttcccctccccggtccgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagacttgg

SEQ ID NO: 4812 - DNA, 885 bp, Homo sapiens
agggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcacc

SEQ ID NO: 4813 - DNA, 1332 bp, Homo sapiens
cgggcttcccctccccggtccgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagacttgg

SEQ ID NO: 4814 - DNA, 1424 bp, Homo sapiens
gagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagttggctgctgtgtatggcagggcccacagtcacatttaccatcggctgccaacccccgcctctgtctgggaacctctgaaccttgactgcccatctaagtccacccgcctctgtgttggtgcctaggagagcgtaagaagcctcagcccctggctcacccctccctccggtcaaagtccactgcatatcctgctttcagcctcaagagaggcattctcagtcaggacttctgccctcttcctgcctccaggatagccctggtgtttccccgtgatgtaattcccagggaagatggacgttgattgctcccaagtctcactggcatccttcctttgttttactcaagggaacctgtctcttctcagctttctgtggtgttctgtggttcctcctgctcagcatatttatagactccaacttttccttcccactctggtctagtgatcctcagttgttgcctgaatcattgcagaagcctctcagcctggctccctccttccttctttggccctcaactgcatttggaatgtgcctttagagcctgcgttagcacatgtcacttttgcaaaaatcctccagtgattctcatttcactcagcatcacagcctgtgtcctgccatggtccataagatctgctccctccgtacttctttgatgctatgttcaagctacttgtcctcctcgttcacatgattgcatcgcttgagcttcttgctactccttgaacaggcccgtcccatcccacctc

SEQ ID NO: 4815 - DNA, 972 bp, Homo sapiens
ccccttggagctgggtggcagaggagataaacagccatgtgcaactctccacactatatttaacagctgcggcggagaaggcagggaggcagccacggtggcggctctgggggcagctcttgtcttcggggagaaggcccttggagccgggctggcatcggccttctcggggtgagcgaggtcaccatgccagcttcccagagccgggcccgtgcccgggaccgcaacaacgtcctcaaccgggctgagttcctgtccctgaaccagccccccaaggggggcccggagccccgcagctcgggcagaaaggcctcgggcccatcagcacagcccccacctgctggtgacggggccagagagcgacgccagtcacagcagctgccagaggaggactgcatgcagctgaacccctccttcaagggcatcgccttcaactccctgctggccatcgatatctgtatgtccaagcggctgggggtgtgcgctggccgggcggcgtcctgggccagtgcccgctccatggtcaagctcatcggcatcacgggccacggcatcccctggatcggaggcaccatcctctgcctggtgaagagcagcacactggccggccaggaggtgctcatgaatctgctcctggattagcaccgccctgtgccaggtgccacgtggggcccatgtggaggcaagccattccctccacccagaggtgatgcccagcccccgtccggcccacccttcgggcaccaccaggtccccaaggtgccccaggaagcttccaccctccacgccaggcccgcatcgatttccttgtctttcccggtgtggccatcatttgagggacatgtgaggtggaggtctcaggcaaggcaaacattaacaaggggtctcagttccaaaagggcattgggttggaccacggagaacatcagttccagaggaagttacaataaaaacacgtatctccctgctcta

SEQ ID NO: 4816 - DNA, 2095 bp, Homo sapiens
aaatagcccaggcccgaggcagccaggccgcagctgtggactcctcacctcccggaggctctgctggtgcaggccccgcattggagggctcgattggctgcccggctggcactgacgtccccttggagctgggtggcagaggagataaacagccatgtgcaactctccacactatatttaacagctgcggcggagaaggcagggaggcagccacggtggcggctctgggggcagctcttgtcttcggggagaaggcccttggagccgggctggcatcggccttctcggggtgagcgaggtcaccatgccagcttcccagagccgggcccgtgcccgggaccgcaacaacgtcctcaaccgggctgagttcctgtccctgaaccagccccccaaggggggcccggagccccgcagctcgggcagaaaggcctcgggcccatcagcacagcccccacctgctggtgacggggccagagagcgacgccagtcacagcagctgccagaggaggactgcatgcagctgaacccctccttcaagggcatcgccttcaactccctgctggccatcgatatctgtatgtccaagcggctgggggtgtgcgctggccgggcggcgtcctgggccagtgcccgctccatggtcaagctcatcggcatcacgggccacggcatcccctggatcggaggcaccatcctctgcctggtgaagagcagcacactggccggccaggaggtgctcatgaatctgctcctggccctgctcctggacatcatgacggtggccggcgtgcagaagctcatcaagcggcgcggcccgtacgagacgagccccagcctcctggactacctcaccatggacatctacgccttcccggccgggcacgccagccgcgccgccatggtgtccaagttcttcctcagccacctggtgctggcggtgcccctgcgtgtgctgctggtgctctgggccctctgcgtgggcctgtcccgcgtgatgatcggccgccaccacgtcacggacgtcctctccggctttgtcatcggctacctccagttccgtctggtggagctggtctggatgccctccagcacctgccagatgctcatctctgcctggtgaagcgcccgccggcccacacaagcctctgggggcagggctggccctagagaaggggcagggggtggcgaggtggcgggcgtgggtggaacagagcggccaggagtcagagcggccacccccacctcatcttcccctcctggctggaggctggcgaacccaggccacccctcccggagacaagcgtgtttggcagtgccaggcctcttgcccctttgcttggactccaagtctcctctctaggcagccaggacccacccatggggacagccctatttagcttctgctctgggaacagcaaaaatcaggatggtgggaggggccgagtcttgtcttgtcctttcatcatcatgactgttgagttcttggctgtgcccatcacgccacagcacgacgcctgccaaaatgcccccaacctactgcctgatgcaggtgccattgccattagcggtcatcgacagcttagggcagcactttccaacgggtgcccatgggacaccagcctgcgagatgcttttgggggaaaggggttttgtggttcaataactttcggaagtgctgcacactctgtccccaagttggacattcacaaaggccgttattgccgtaaaggctctgacaagccctatagaaaagcttcttgctaaaccttctttaacccatgttttctaaacttatttgaccacagaacccttttcttggggaacagctattaacccccaaggaattattggttcctcaagtgcgttttgggagctgctgccagagagctaaagggcctggggtgtgagctgactctcctctggggaggccgggtgcacacgccacagcccgaggaaagtgctggccaccgcccgtgggcatcgatgaggctttggcccccaggggccggactccgtgtgacctaataggtcgtttccaagtcacccgttttggatgtgcatttcatgtgacaatacagatgacatgcaaatggcc

SEQ ID NO: 4817 - DNA, 1550 bp, Homo sapiens
cctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggcttccatgcctatggctgttctaaaattgggccaaatatatccatttcagagaggctttttctgtaaagacaacagcatcaactatccgtaccatgacagtaccgtcacatccactgtcctcatcctagtgggggttggcttgcccatttcctctattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaa

SEQ ID NO: 4818 - DNA, 1597 bp, Homo sapiens
gctgctcagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatat

SEQ ID NO: 4819 - DNA, 3292 bp, Homo sapiens
agtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgactttagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccaggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagtttccctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaa

SEQ ID NO: 4820 - DNA, 1306 bp, Homo sapiens
ctcctctccgcgcggggcgggctccgcgccacgtgactccgcggccgggccgggacgcgacgggacgcgctgggaccggcgtcgggggtcgcggggaccatgcagcggaggtgggtcttcgtgctgctcgacgtgctgtgcttactggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttc

SEQ ID NO: 4821 - DNA, 1373 bp, Homo sapiens
ccctggaggcggggacctcgcgtgaggaccagacctccctccgcgccccgcactgcgcgcgccctcccaggctcgggggtccccgcgtcccaggcccagggggatgggggtcgcgagaggcccggggagccggggccagcatcccccgccccggcagcaggaagtctgtgcggaggggccgcgcgcgcgcctccatcccgccccgcctggcctgggagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttc

SEQ ID NO: 4822 - DNA, 1265 bp, Homo sapiens
ctcctctccgcgcggggcgggctccgcgccacgtgactccgcggccgggccgggacgcgacgggacgcgctgggaccggcgtcgggggtcgcggggaccatgcagcggagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttc

SEQ ID NO: 4823 - DNA, 1013 bp, Homo sapiens
ggctctataggtccggttccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 4824 - DNA, 1050 bp, Homo sapiens
acttacccggctctataggtccggttccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatcccagcacctgcgggagctgtgggatcagaggcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgacccc

SEQ ID NO: 4825 - DNA, 895 bp, Homo sapiens
ggcgaggagaggcacaccactattgttttaatttgcttttacctgattcctggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 4826 - DNA, 1008 bp, Homo sapiens
ctgaccacagagcgctgctcccgagaaccctgcacccctcaatggagtaaattaccataaagcctcttccttacccatgctttggggtgttaacagctgaggctattcgtcggtgacctgtgggactcgagctattcctgcagctcagcagacctcctggccgtggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 4827 - DNA, 662 bp, Homo sapiens
ggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatcctctgcccatgtggcagataccccttcccacagagggggccccgtgccatgagggaagc

SEQ ID NO: 4828 - DNA, 960 bp, Homo sapiens
ggggcgcgtggctgcagcggggcccgcgtggtgcctcctgaggcggcccccggatgaagagatctgggaacccgggagccgaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatcagcccagcacctgcgggagctgtgggatcagaggcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 4829 - DNA, 890 bp, Homo sapiens
cccaaagtacttgtgtccgggtggtggactggattagctgcggagccctggaagctgcctgtccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaatcatc

SEQ ID NO: 4830 - DNA, 2187 bp, Homo sapiens
cggcgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggtcaccatggctgttattggctcccttgctgtccccagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggggcagataagagtagccaagaggcgggtcgtgatggcatccctctacctggggacaggtcctttggaacaggagctggtggactgcctggaaagtactctagaaaagtcactccaagcaaagtttccttcaaatctcaaggtctccattctcttagacttcacgcggggctcacgaggccggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctctgcagagctgggctctaccccaaaaggcttcaggccagctgccacggctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcat

SEQ ID NO: 4831 - DNA, 1700 bp, Homo sapiens
ctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggtggactgcctggaaagtactctagaaaagtcactccaagcaaagtttccttcaaatctcaaggtctccattctcttagacttcacgcggggctcacgaggccggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttcccgagagttcacaggaatggccttgatgaagatgacaggcatggccggggtcagctctttcagccgcgcttcagcgatgactccagtctgggtgt

SEQ ID NO: 4832 - DNA, 1768 bp, Homo sapiens
atgaaggtggactgcctggaaagtactctagaaaagtcactccaagcaaagtttccttcaaatctcaaggtctccattctcttagacttcacgcggggctcacgaggccggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatgcctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctctgcagagctgggctctaccccaaaaggcttcaggccagctgccacggctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcat

SEQ ID NO: 4833 - DNA, 3029 bp, Homo sapiens
acgtgacgccactgtcgctgcgacgataaggcctggcgttattgcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatat

SEQ ID NO: 4834 - DNA, 3203 bp, Homo sapiens
gacgataaggcctggcgttattgcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 4835 - DNA, 2787 bp, Homo sapiens
cctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaa

SEQ ID NO: 4836 - DNA, 3218 bp, Homo sapiens
gcctggcgttattgcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 4837 - DNA, 2007 bp, Homo sapiens
ccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacgtggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaat

SEQ ID NO: 4838 - DNA, 2629 bp, Homo sapiens
attgcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggtacggacccctccccggcgtctccgctcccctgaccccacatcccctagaagaccttttttctgagcctcgctgctcggatttcttctcggcgctccccggtggtctcttccattatggtccccacctcagaaattttttttaaccgctccagcgtctcttttctgtattcttacaactttgtggcaaccacctctactggccccacttcgaccttccttcctgatcaccacaaagagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaaggtacgtacggctggttcctgggagtgtgacgtagtccttctgctcaggttgttcttgttatttcaggctgcctttcgtttaccagactctggttgaacacctggtgtgtgccacgtgctggcagtgccctggacagggggcctcagggaaggacgtggagcagccttatcccaggcctctgggtgtcccgacacaggtgttcacatctgtgctgtcaggtcagatgcctcagttcttggaaagctaggttcctgcgactgttaccaaggtgattgtaaagagctggcggtcacagaggaacaagcccccccgctgagggggtgtgtgaatcggacagcctcccagcagaggtgtgggagctgcagctgagggaagaagagacaatcggcctggacactcaggagggtcaaaaggagacttggtcgcaccactcatcctgccacccccagaatgcatcctgcctcatcaggtccagatttctttccaaggcggacgttttctgttggaattcttagtccttggcctcggacaccttcattcgttagctggggagtggtggtgaggcagtgaggaagaggcggatggtcacactcagatccacagagcccaggatcaagggacccactgcagtggcagcaggactgttgggcccccaccccaaccctgcgcagccctcatcccctcttggcttgagccgtcagaggccctgtgctgagtgtctgaccgagacactcacagctttgtcatcagggcacaggcttcctcggagccaggatgatctgtgccacgcttgcacctcgggcccatctgggctcatgctctctctcctgctattgaattagtacctagctgcacgcagtatgtagttaccaaaagaataaacggcaataattgagtcctc

SEQ ID NO: 4839 - DNA, 1784 bp, Homo sapiens
actgtcgctgcgacgataaggcctggcgttattgcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggtgtccagcctactgacagcagctttgaagtacatagtgcatttcccaagaaccgtgggtaaagaaaaaagcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaaggtacgtacggctggttcctg

SEQ ID NO: 4840 - DNA, 2588 bp, Homo sapiens
cctgcggcttcgatccctttccactgggtattgagattggcgaggggagaggcgcagaaacggcgtactctagtgcagtggttcaatctcggctcactgcaacctccgcctccccgattcaagcgattctcctgcgtcagcctccccagtagctgagactacaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctgagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgcttgagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatataatta

SEQ ID NO: 4841 - DNA, 3690 bp, Homo sapiens
gcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgcttgagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataat

SEQ ID NO: 4842 - DNA, 2439 bp, Homo sapiens
gcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctgagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgcttgagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataat

SEQ ID NO: 4843 - DNA, 4066 bp, Homo sapiens
ctcccgagaacctcaccccccggtattcccctcaccctgaagtaagggagtctccctcttcccctcagctcctaaccaaggtgctcagtaccgcggctagggtgcccagcgggaggctgggtagttaccggaggaggcagagccggtcgcacgcctgggtcccagcggaggcccagtcgactctcgacccgggccccagcctccttgcgtggcgaaggtcgtgcctcaggtctcctggcgaacctggccgcccggaagcggagagtgactcctccccttcgtcccctcggtgcccgccaggcggcgccgtcggctgggcccggattcccctgcggcttcgatccctttccactgggtattgagattggcgaggggagaggcgcagaaacggcgtgatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgcttgagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatataa

SEQ ID NO: 4844 - DNA, 2846 bp, Homo sapiens
gtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctgga

SEQ ID NO: 4845 - DNA, 603 bp, Homo sapiens
cacttcctccagttctagtttccaacaacagaggctgcagccacccagccccgaagcagggcccagcgagacagggcccagccccaagcgtgacccagctgcagagaagctgagacggtgattcggactgactggactctggcctccagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccg

SEQ ID NO: 4846 - DNA, 3006 bp, Homo sapiens
gcggcaacgcgcggagccggcggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctggagcgcaggctcggtcccgggtccatgtg

SEQ ID NO: 4847 - DNA, 916 bp, Homo sapiens
aggcctcctaatcgggggcagacaggcagggagggtgtggctgggctgggctgggcggggcggcctggggcaggggtgtggcccctaaatgtccccaacctcagagggacctagagtcctgagcctccagtagcttctctgggcctggcagagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggc

SEQ ID NO: 4848 - DNA, 1915 bp, Homo sapiens
ctagtttccaacaacagaggctgcagccacccagccccgaagcagggcccagcgagacagggcccagtggggccttattctctctcttgcagccccaagcgtgacccagctgcagagaagctgagacggtgattcggactgactggactctggcctccagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactga

SEQ ID NO: 4849 - DNA, 1286 bp, Homo sapiens
gtagttaggtgctcaataaacggagttgccgctgaggtctgggctggggtcttgttcctgggatcgggaggggctggacgcctgtgtgttctctcctgacgatcgctggcggcagcctctgggctggtcctaccagggctcaaaattcccggcaccactggccttggggatctgggggcggcccctctgcagacaacagagtgacgggggcgggaccgggctggggctggggccttcctggaatcccgcagggcctggggacctgttcacttggggaggctgggagccaggcggggtccgggttccacgaaggccaggtccagtcagtttctcagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgac

SEQ ID NO: 4850 - DNA, 586 bp, Homo sapiens
ggaagtggggctcgggtcccgcggcggggctggaggcagcgagcgccgtcgtctgcccgggcccgcccatcggggtccccaaccccatccggaccccgccgcccgagcgcgcggccccggaagcacccgtagagacttggtttcacccccatcgaggctggtcttaagctcctgacctcaagtgatccgcccgcctcggcctcccaaagtgctgggattacaggcgtgagccaccgcgccagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccg

SEQ ID NO: 4851 - DNA, 2054 bp, Homo sapiens
agaggacttacaggtcacaccaccccgacgtgtgcatcctgctctgttccctcgtccctaaggatgtggtgggctctgagacctccaggcatcctgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcgggttcagaaccctggagacctgaggccacaggcctttgttcttctgccttgggattttctgggcttgggagtctgaactgcaggccaggggccaagcgcggcaaagtcagaggcactaggagccagcagggcggccaccatccactggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccag

SEQ ID NO: 4852 - DNA, 2112 bp, Homo sapiens
cccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggtgtgggcctgccctggtctctgcagggctgggtgcgtgccctctggccccttctccatccccctctgcaccacgctgacccctccggccaggcaggcctcctcctgcggccccaggctgtgctggccaccctcatgccggccgggccggacctcccttccaggaaggccaacacggtggcctctgtgctgctggacgtggccctgggcctcatgctgctgtcctggctccacgggagaagccgcatcgggcatctggccgacgccctcgttcctgtggctgacgtgagtggactggggtggagcccggtgtcccgggtgggcgtggggacccctcctgggcagcagagccttcccgggccagagccaccgccccacaaagccagttctaccttctccatgctctggagacacggccctcccctgaaccagaagcaggaactccaggggcgctggggcctgggcagggcaggcctcgcaggtacacccccctttccttctgaaggggctgtgtgcaggagccagccgggctgaggctctggggagcccgcctctccctgtgggcccagcgtcctggtatctcccttgtggtccctgagatcagcgttgccctcctggctctctggggccctctgcagagccagggtcatgaaacctttcctgtccagggaggcccatgtgcagcccagctgggacttcctgccctgcccctgtgctgattctgtaactcctgtgctgagagccagaggcacagcttgtctcccatctcccaccttccctgcatggtctgtgccccgtttccagccgggtgcagccccctcctctgcagatctagtgcatttccatgctgcctctgggccttcagcttctctgtcttcctccctcagcaccaaagccccgtctcttccattaggagcttgtcttcctgctgggggtggtacctgactctttggcccaccctcgggcctctgtggaggcctccttgaggcctgactgggtgggtcttgtgtgggctgcaggtgtgcactgggcctgcttgtggccaggccaggcctctgggggcagcatcaggcacgtctgtgtggctgtgggggtgcagggagctccagcccagaaggaaggaggggcggggctggggaaggggctcggcagctttgcctgtggtcgtccgcacctgccaccggcctactttgtcctagacctcccttttgcaaaagtgctcagaaatataaatatttaatttaaaaa

SEQ ID NO: 4853 - DNA, 1725 bp, Homo sapiens
caacctttcctgaatgccctcggtgccgctcttctctgtggactctcagattctttactatgcaatgttgggggtgaatccccgttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggttgggagccttgtatataatgttgactccaaaacctataatgcctcagtgctgccagtgagagtcgaggtggacatggtgcgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgat

SEQ ID NO: 4854 - DNA, 2529 bp, Homo sapiens
acggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgata

SEQ ID NO: 4855 - DNA, 2775 bp, Homo sapiens
atggcggccgccggggctgcggctacacacctaggtgcggtgggcttcgggtggggggcctgcagctagctgatggcaagggaggaatagcaggggtggggattgtggtgtgcgagaggtcccgcggacggggggctcgggggtctcttcagacgagattcccttcaggcttgggccgggtcccttcgcacggagatcccaatgaacgcgggcccctggaggccggtggttggggcttctccgcgtcggggatggggccggtaccctagcccgtttccagcgcctcagtcggttccccatgccctcagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgata

SEQ ID NO: 4856 - DNA, 1984 bp, Homo sapiens
ccccacggtggccggagcagccggaagctagcatggcggccgccggggctgcggctacacacctagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaa

SEQ ID NO: 4857 - DNA, 1939 bp, Homo sapiens
agcggaagtcacttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggtt

SEQ ID NO: 4858 - DNA, 2235 bp, Homo sapiens
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggtt

SEQ ID NO: 4859 - DNA, 1585 bp, Homo sapiens
aagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgg

SEQ ID NO: 4860 - DNA, 2044 bp, Homo sapiens
agcggaagtcacttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatggttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggtt

SEQ ID NO: 4861 - DNA, 1691 bp, Homo sapiens
aagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctg

SEQ ID NO: 4862 - DNA, 2077 bp, Homo sapiens
agcggaagtcacttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggtt

SEQ ID NO: 4863 - DNA, 1429 bp, Homo sapiens
ggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctc

SEQ ID NO: 4864 - DNA, 1361 bp, Homo sapiens
tcctggaggaccagggggcggggcctgcccggctggcctggacgaacgggaagccgggagctcggccacgggtggcgaggctgcggtgaggcctggtctccggctgccagaccatgctgagtggagcacgctgcaggctcgcctcagcgctgcggggaacgcgcgcgccgccgtccgcggtcgcccgtaggtgcctgcacgcgtcggggtcgcggcctttggccgaccggggcaagaagactgaggagccgccccgcgacttcgatccggcgctgctggagttcctggtgtgcccgctctccaagaagccgctcagatatgaagcatcaacaaacgaattgattaatgaagagttgggaatagcttatccaatcattgatgggatccctaatatgataccacaggcagctaggatgacacgtcaaagtaagaagcaagaagaagtggagcagcgctagttcataatttaaaaaaattaaaaaaacgcaacagccaacttttcttaataccatataccttttaaaacacagtggcaggtaataagtggaagagaagaatgtttctgtctcttcctacgttgactgttcttattccactggtttctttagcaggactgttctactcagcctctgtggaagaaaacttcccacagggctgcactagcacagccagcctttgcttttacagcctgctcttgcctattaccataccagtgtatgtattcttccacctttggacttggatgggtattaaactcttcaggcataattgatgcaactagagtcaatatgctgtatatattaatgatagctcttgggcatcgatctctgaaagctcaaatggatggaatttagtttgcgggaaagaggctttgctttgcgcatatcaggcttaggactgtgggaggcttaagttgcagatgcttcttttattgtactcttgttctgcccttgttttttgaaggctctgacttataactgctgtatcagaagaaacattttgacagtgtcttggttggagatgaacatccctaattgacatgtgatgactatttcttattccattcatctaagagtcattgaaattttgttttgcttgtttgtttagcttcaaggtctttggtaaagtcacatgttaaggatgactgaaataattccaaaggagtgatgttggaatagtccctctaagggagagaaatgcatttgaacgaatgtgatataaaaccacataatcaaatagaaacttcatgtacttacaaaaactgagtttgtaaaattaccttcatttctttgacattaaatgcttatattagcaataaacatgttgacactttcctataaaaaataaaccagtttgcagta

SEQ ID NO: 4865 - DNA, 217 bp, Homo sapiens
atgtttctgtctcttcctacgttgactgttcttattccactggtttctttagcaggactgttctactcagcctctgtggaagaaaacttcccacagggctgcactagcacagccagcctttgcttttacagcctgctcttgcctattaccataccagtgtatgtattcttccacctttggacttggatgggtattaaactcttcaggcataattgat

SEQ ID NO: 4866 - DNA, 6785 bp, Homo sapiens
cctgcaggatgctggcacgtgtgtcctggtcctcaacaaccttctgtgagcctagggacccatttctcctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggtcgagaccgtgcagagaaaccctgagctggtcctggagggcggccccctggcccctctcccccacggggacggcttcctggaaaccagtatgcctgttcccgcgcccacctggcaagacgggccccgcccgggctgtgccgagtcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagatcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtcccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggcttc

SEQ ID NO: 4867 - DNA, 6736 bp, Homo sapiens
cctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagaaggcccccgatgcgctcagccatacccccagcgtcaggcgtctgtccctgctcgccctgcccgcccccagccccaccacccctggcccccaccctccagccaggaaggcaagccctggcctggagagggcccctggcctccctgagctggacattggagaagtcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtcccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggcttc

SEQ ID NO: 4868 - DNA, 5899 bp, Homo sapiens
cctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgttttggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagaaggcccccgatgcgctcagccatacccccagcgtcaggcgtctgtccctgctcgccctgcccgcccccagccccaccacccctggcccccaccctccagccaggaaggcaagccctggcctggagagggcccctggcctccctgagctggacattggagaagtcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtcccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggcttc

SEQ ID NO: 4869 - DNA, 663 bp, Homo sapiens
gtttagtttggttttggtttgctagtgagcggaaaatctgatgtgacaccttaaaggccagcccacaagtggcagcacctgatcgtcatctctgctctcagcctctatgggaggcacccggccctgccgttgctgctgggcttcctctgccctgagggctttcgtgtgagctcagggcaatgcaagtgtgtgttcagttaccaagcccaaaagtcaaaagaacagccagagccaagctggcttttgaggagagaggccggctcctccagcctggctgcatttgcctgaggtagatcgtgagtgctctgccccagcctctccgccctcctgtgtcctttctcagcggctgctctaaagtataacttcacgtagtggtgacttaacttgaaaggagccgcagggggcgtgagagcagcttggagaggtgggagcctgggccgccgatggctccagcctgtgaaagtgtggaaagctcgttccaggaaaattggaataatcacctcattggctggctttcaggcggggtccttggtgaattttgtcatggttatttaaggaaccttgcctagaagtcccaacttgcagttccccatcgacgggaaggcttggactccaagatgattataaaggaatatcggattcctctgccaatgaccgtggagg

SEQ ID NO: 4870 - DNA, 564 bp, Homo sapiens
ccctttccaccgacttgctcctgcagagacatcctgcactcctctccctcccactgaagtgtgggctgggtgcctctccaaacaccccggcctacctgcctcccccacccagagtcgggattcttcaaaggagacctcactggaacatctgtctttgtccacaaccagctctctccccggcctccacctgggagtgaccagagctgctaggatagaccccccacttctggagggaaggcagatgctggcacgtgtgtcctggtcctcaacaaccttctgtgagcctagggacccatttctcctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagat

SEQ ID NO: 4871 - DNA, 6660 bp, Homo sapiens
aaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagaaggcccccgatgcgctcagccatacccccagcgtcaggcgtctgtccctgctcgccctgcccgcccccagccccaccacccctggcccccaccctccagccaggaaggcaagccctggcctggagagggcccctggcctccctgagctggacattggagaagtcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtcccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggctt

SEQ ID NO: 4872 - DNA, 5734 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagagccagagagctggatatggggtcggggatcgggagttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaatttttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcattgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaca

SEQ ID NO: 4873 - DNA, 1312 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgaggagattctcgttctgtccccaggc

SEQ ID NO: 4874 - DNA, 3886 bp, Homo sapiens
agatctgaatgagtcaaagccggcggcctcggctcctcagctccacctgacagtaggccgctgatcggccgcgggtcttgtcgaccgctaggccaccaggttcatgtggaggctcccaggcgcccgcgccgcgcttcgggtgatccggacggcggtggagaagctgagccgggctgaagcggggagccagacagcggcgggagcgatggagcgcgctgtagtgcgctgcgtaccttcggaacccaagctgagcctgtcattcgctttggctgatggtagccacaagaacatgcagcgcgaccagagcgagccgctgggtcgagtcctcagccgcatcgctaccaatgccctaaagggtcacgctaaggcggccgccgccaagaagagcaggaagagccggccgaatgctagcggcggtgcggcctgttcagggccggggcctgagccggctgtgttctgcgagcccgtggtgaagctgtactaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggtataaggaagccaagcccggagcggcggagcccgaggtcggtgtcccctcgtcattgtctccctcctcaccttcttcttcttggactgagactgatgtggaggagcgtgtctacaccccgtccaatgccgacatcgggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtttcagttcttcagtctacaaaggactcttctaaaaggatatgtgttgctaatacccatctttactggcatcctaaaggtgggtatattcgcctcattcaaatggcagtagccttggctcacataagacatgtttcatgtgatctgtatcctggcataccagttatattttgtggggactttaatagtacaccatcaacaggaatgtatcattttgtcatcaatggcagcattccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaaattgagactctcagaaaaggaagattgaattagcgtgttttttgtttgtttgtttttgtttttgtttttgtttttttgagatggagtttcactcttgttgcccaggctggagtgcaatggcacaatctcggctcactgcaacctccgccccctgggtttaagcgattctcctgcctcagcttcccgagtagctgggattacaggcgtgcgccaacatgtctggctaatttttgtatttttagtagaaatggggtttcgccacgttggccaggctggtcttgaactcctgacctcaggtgatccacccacctcggcctcccaaagtgttgggattacaggcgtgagccaccgcacccggcccttgtgtacatttttataagagaatttttttagctaggagttcagaatttttaaagtaccatttgaatgatcttaatttttctttcatgacaacacattccaaaatgaatcatgcttatgtactaagagggaaaatgtatttaagttaagggtgagagacttaagttataggtgaccttagagacctaaggtgagagacttgacacatggaaggagtaacattagggtctacctctacctcaatttagttagcgatttactacaatttcagagctttaacaaaagataaaaataaatcgtcaccaattgttattgcttctcatctttcatttttcaatgaacaagtaaggtattttcattcttatttttaggattttagtttttagtgtatggtacaaatgaacacagtttatattctaattcttactgcagctcattttaatttttaggatgcaagcacaatttagtattcaaagtgagtagcaacatattcaacttgatcccattgtcttcagttactcttgcccatgaaaaatgttcataaatgaacagggtatttgaccatatgatattagaaaatacagcacattactttatgagaaactacctactgatatgggcttgaaattttggatgaatcattgagcatttctacactagaagtaatttcaaaattgttggtttttataaacaggaaaaaggttgagtagtgggacttttaagcatctctgaaataaaaaacttctttttacagacaagcattatagtttgagttacagacaacagtgtgtatatatgtaatatatatatagtaaaatgaaatttaaatatgaagccaaactttttaaaattagaaactacaaatggttatactgattagtgtctagcctagagtggtaaccatgctttactaattcagttatgaaatacattatttataatgcattagctgtattagctgttgcttttttgatgttcaggataactatgttatctcatttctgcatttaattaatagctcgagtattaaaagcccactcccttcaagaaaagctttgattttccccagtcatgaaagcccttgtttcaaattctttaatctctgaacctagtatcataagaatttcctcttttgataacatctgtactttcatattctgctcactatcaaatgtattgttaacacttagtaagtttgaaaatgaaggggttttatctgcatttgacattgaaccttgaagtactttaagtactccaaggggaaaattaaagtggaagtttcttcggatcttgtttagaaaaaactataaataaaaaattgatgctaccaaa

SEQ ID NO: 4875 - DNA, 3040 bp, Homo sapiens
gagatctgaatgagtcaaagccggcggcctcggctcctcagctccacctgacagtaggccgctgatcggccgcgggtcttgtcgaccgctaggccaccaggttcatgtggaggctcccaggcgcccgcgccgcgcttcgggtgatccggacggcggtggagaagctgagccgggctgaagcggggagccagacagcggcgggagcgatggagcgcgctgtagtgcgctgcgtaccttcggaacccaagctgagcctgtcattcgctttggctgatggtagccacaagaacatgcagcgcgaccagagcgagccgctgggtcgagtcctcagccgcatcgctaccaatgccctaaagggtcacgctaaggcggccgccgccaagaagagcaggaagagccggccgaatgctagcggcggtgcggcctgttcagggccggggcctgagccggctgtgttctgcgagcccgtggtgaagctgtactaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggtataaggaagccaagcccggagcggcggagcccgaggtcggtgtcccctcgtcattgtctccctcctcaccttcttcttcttggactgagactgatgtggaggagcgtgtctacaccccgtccaatgccgacatcgggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtttcagttcttcagtctacaaaggactcttctaaaaggatatgtgttgctaatacccatctttactggcatcctaaaggtaggttttatttggtatcacaagtgacttaaacacgcttaaagttgtttaaagtgttttacacaaatgcatatcttgaacgtcacccagagactgtaatttgtgtagtttttcttttttaacttaaagacaactttaaaaaatacttacattaatgttttttatattcataggtgggtatattcgcctcattcaaatggcagtagccttggctcacataagacatgtttcatgtgatctgtatcctggcataccagttatattttgtggggactttaatagtacaccatcaacaggaatgtatcattttgtcatcaatggcagcattccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaaattgagactctcagaaaaggaagattgaattagcgtgttttttgtttgtttgtttttgtttttgtttttgtttttttgagatggagtttcactcttgttgcccaggctggagtgcaatggcacaatctcggctcactgcaacctccgccccctgggtttaagcgattctcctgcctcagcttcccgagtagctgggattacaggcgtgcgccaacatgtctggctaatttttgtatttttagtagaaatggggtttcgccacgttggccaggctggtcttgaactcctgacctcaggtgatccacccacctcggcctcccaaagtgttgggattacaggcgtgagccaccgcacccggcccttgtgtacatttttataagagaatttttttagctaggagttcagaatttttaaagtaccatttgaatgatcttaatttttctttcatgacaacacattccaaaatgaatcatgcttatgtactaagagggaaaatgtatttaagttaagggtgagagacttaagttataggtgaccttagagacctaaggtgagagacttgacacatggaaggagtaacattagggtctacctctacctcaatttagttagcgatttactacaatttcagagctttaacaaaagataaaaataaatcgtcaccaattgtta

SEQ ID NO: 4876 - DNA, 4315 bp, Homo sapiens
tgcattatcagacctgctccaacctcctcccagagccagccgagcagcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccgcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttttctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctctgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacca

SEQ ID NO: 4877 - DNA, 3355 bp, Homo sapiens
gacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccggttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttttctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctctgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacc

SEQ ID NO: 4878 - DNA, 4275 bp, Homo sapiens
atgagttacattttaaagatgcctggtacatgcctgccaggagaaggcacaacatatgaactccctccctcttccctccacccctcctcagctcctgtgacatcaggagggacatgccctgccctgctcacagaggctgggtgggaggctcccatcatggccttcactgaggctgcctctgcagttggaccaagctggacacacagtagggcctcagtttcatcaactgtaaaaacagagaggagaaggagggttcttcaggcctgtggaatggtcaggcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttttctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctctgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacc

SEQ ID NO: 4879 - DNA, 4041 bp, Homo sapiens
atgaagaaacagaggatccaggaggggaaatcgcttgcccacaggcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttttctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctctgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacc

SEQ ID NO: 4880 - DNA, 3119 bp, Homo sapiens
actcgggcggaccaggcgaagctgtcgcggacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttttctgagagcacaggggtga

SEQ ID NO: 4881 - DNA, 7576 bp, Homo sapiens
gggggccactgggaattcagtgaagagggcaccctataccatggcagtgcccggcgacgctgcacgagtcagggacaagcccgtccacagtggggtgagtcaagcccccacggcgggccgggactgccaccatcgtgcggaccccgcatcgccgcgggactcgggctgccgtggctgctggggagacctggtgctgcagccgctccggagctctcggaaactttcctccgcgctgtgcgcgggctccctgtcctttctgctggcgctgctggtgaggctggtccgcggggaggtcggctgtgacctggagcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatcacttactctcactccccgccgcgggggtggtgctcagctgcttggccgccgcgacatggctggtgctgaggctgaggctgggcgtcctcatgatcgccttgactagcgcggtcaggaccgtgtccctcatttccttagagaggttcaaggtcgcctggagaccttacctggcgtacctggccggcgtgctggggatcctcttggccaggtacgtggaacaaatcttgccgcagtccgcggaggcggctccaagggagcatttggggtcccagctgattgctgggaccaaggaagatatcccggtgtttaagaggaggaggcggtccagctccgtcgtgtccgccgagatgtccggctgcagcagcaagtcccatcggaggacctccctgccctgtataccgagggaacagctcatggggcattcagaatgggaccacaaacgagggccaagaggatcacagtcttcaggaaccagtattactgtggacatcgccgtcatgggcgaggcccacggcctcattaccgacctcctggcagacccttctcttccaccaaacgtgtgcacatccttgagagccgtgagcaacttgctcagcacacagctcaccttccaggccattcacaagcccagagtgaatcccgtcacttcgctcagtgaaaactatacctgttctgactctgaagagagctctgaaaaagacaagcttgctattccaaagcgcctgagaaggagtttgcctcctggcttgttgagacgagtttcttccacttggaccaccaccacctcggccacaggtctacccaccttggagcctgcaccagtacggagagaccgcagcaccagcatcaaactgcaggaagcaccttcatccagtcctgattcttggaataatccagtgatgatgaccctcaccaaaagcagatcctttacttcatcctatgctatttctgcagctaaccatgtaaaggctaaaaagcaaagtcgaccaggtgccctcgctaaaatttcacctctttcatcgccctgctcctcacctctccaagggactcctgccagcagcctggtcagcaaaatttctgcagtgcagtttccagaatctgctgacacaactgccaaacaaagcctaggttctcacagggccttaacttacactcagagtgccccagacctatcccctcaaatcctgactccacctgttatatgtagcagctgtggcagaccatattcccaagggaatcctgctgatgagcccctggagagaagtggggtagccactcggacaccaagtagaacagatgacactgctcaagttacctctgattatgaaaccaataacaacagtgacagcagtgacattgtacagaatgaagatgaaacagagtgcctgagagagcctctgaggaaagcatcggcttgcagcacctatgctcctgagaccatgatgtttctggacaaaccaattcttgctcccgaacctcttgtcatggataacctggactcaattatggagcagctaaatacttggaattttccaatttttgatttagtggaaaatataggaagaaaatgtggccgtattcttagtcaggtatcttacagactttttgaagacatgggcctctttgaagcttttaaaattccaattagggaatttatgaattattttcatgctttggagattggatatagggatattccttatcataacagaatccatgccactgatgttttacatgctgtttggtatcttactacacagcctattccaggcctctcaactgtgattaatgatcatggttcaaccagtgattcagattctgacagtggatttacacatggacatatgggatatgtattctcaaaaacgtataatgtgacagatgataaatacggatgtctgtctgggaatatccctgccttggagttgatggcgctgtatgtggctgcagccatgcacgattatgatcatccaggaaggactaatgctttcctggttgcaactagtgctcctcaggcggtgctatataacgatcgttcagttttggagaatcatcacgcagctgctgcatggaatcttttcatgtcccggccagagtataacttcttaattaaccttgaccatgtggaatttaagcatttccgtttccttgtcattgaagcaattttggccactgacctgaagaaacactttgacttcgtagccaaatttaatggcaaggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacagggtgatgaagaggccagccttggattacccataagccccttcatggatcgttctgctcctcagctggccaaccttcaggaatccttcatctctcacattgtggggcctctgtgcaactcctatgattcagcaggactaatgcctggaaaatgggtggaagacagcgatgagtcaggagatactgatgacccagaagaagaggaggaagaagcaccagcaccaaatgaagaggaaacctgtgaaaataatgaatctccaaaaaagaagactttcaaaaggagaaaaatctactgccaaataactcagcacctcttacagaaccacaagatgtggaagaaagtcattgaagaggagcaacggttggcaggcatagaaaatcaatccctggaccagacccctcagtcgcactcttcagaacagatccaggctatcaaggaagaagaagaagagaaagggaaaccaagaggcgaggagataccaacccaaaagccagaccagtgacaatggatagaatgggctgtgtttccaaacagattgacttgtcaaagactctcttcaagccagcacaacatttagacacaacactgtagaaatttgagatgggcaaatggctattgcattttgggattcttcgcattttgtgtgtatatttttacagtgaggtacattgttaaaaactttttgctcaaagaagctttcacattgcaacaccagcttctaaggattttttaaggagggaatatatatgtgtgtgtgtatataagctcccacatagatacatgtaaaacatattcacacccatgcacgcacacacatacacactgaaggccacgattgctggctccacaatttagtaacatttatattaagatatatatatagtggtcactgtgatataataaatcataaaggaaaccaaatcacaaaggagatggtgtggcttagcaaggaaacagtgcaggaaatgtaggttaccaactaagcagcttttgctcttagtactgagggatgaaagttccagagcattatttgaattctgatacatcctgccaacactgtgtgtgtgtgtgtgtgtgtgtgtgtgtgtgtgtgtgtgtgtgaaagagagacagaagggaatggtttgagagggtgcttgtgtgcatgtgtgtgcatatgtaaagagatttttgtggtttaagtaactcagaatagctgtagcaaatgactgaatacatgtgaacaaacagaaggaagttcactctggagtgtctttgggaggcagccattccaaatgccctcctccatttagcttcaataaagggccttttgctgatggagggcactcaagggctgggtgagagggccacgtgtttggtattacattactgctatgcaccacttgaaggagctctatcaccagcctcaaacccgaaagactgaggcattttccagtctacttgcctaatgaatgtataggaactgtctatgagtatggatgtcactcaactaagatcaaatcaccatttaaggggatggcattctttatacctaaacacctaagagctgaagtcaggtcttttaatcaggttagaattctaaatgatgccagagaaggcttgggaaattgtacttcagcgtgatagcctgtgtcttcttaatttgctgcaaaatatgtggtagagaaagaaaaggaaacagaaaaatcactctgggttatatagcaagagatgaaggagaatatttcaacacagggtttttgtgttgacataggaaaagcctgattcttggcaactgttgtagtttgtctttcaggggtgaaggtcccactgacaacccctgttgtggtgttccacacgctgtttgttggggtagcttccatcggcagtctggcccattgtcagtcatgcttcttctggccggggagattatagagagattgtttgaagattgggttattattgaaagtctttttttttgtttgttttgttttggtttgtttgtttatctacacttgtttatgctgtgagccaaacctctatttaaaaagttgatactcactttcaatattttatttcatattattatatatgtcatgatagttatcttgatgtaaatatgaagatttttttgtttctgtagatagtaaactctttttttaaaaaaggaaaagggaaacatttttataaagttatattttaatcaccatttttatacattgtagttctctccaagcccagtaagagaatgatgattcatttgcatggaggtcgatggacaaccaatcatctaccttttctaatttaaatgataatctgatatagttttattgccagttaaatgaggatgctgcaaagcatgttttttcactagtaacttttgctaactgaatgaattctgggtccatatctcccagatgaaaaactgttaaccaataccatattttatagttggtgtccatttctttccaacactgtttgttatgattcttccttgagtacttatatacagacctgctcattatctaaacaatcttaccttctaagtaaaccttgattgtgatttccagtttttattttctctgacgtagtagaaaggaatgtttacattaaaaatacttttgtttctcataaatggatattgtactcccccctttcaaagcattattttacaataattcatggcattttaaaaaataaggcaaagataatacgacaaaaaatatacatggtttcaaggcaaattctccaataagttggaaaatgtaaaaaggatcaagtggatgcagcctctacctaaataattaaaatatatttcagtatatttctgaattaacaccaggtcttcattatttagaacttactaaattgttttcattttcttagttttacctgtgtatctccatgtttgcaaaaattactataagtcaaattttgccagtgaatttaactatttttctttccttgcaattaaggggaaaaaagcatttatcttatcttctcataccccttgcatctaagtacttagcaaagtcaatattttcccattttccaaatgcgtccatctctaacataaatattaattgaacatagagctatgtttggagtgagtggactggcaggacagttggaagtccatcacagtctattgacagtttcatcaaagctgtatagtccaactagtggggcagcttggctactatggtggaagtctcagcaaactgcctggttttgtttgtttgttttgttttaaggtacaggaaataagaggaataatagtggccaaagcaattagaacatcttcattccagaactgtgttcagcaatccaggcagattgatacatttttctttaaaaataaattgctattacagctagacgtcaattgggataaataaagggatgaagatccactaagtttgtgactttcatacacacccagtacatctcaaaggatgctaagggacattttctgccagtagagttctccccctttttggtgacagcaatattattatgttcacatctaactccagagcttacttcctgtggtgccaatgtatttgttgcaatttactacatttttatatgagcctatttataggtgccattaaactcaggtctttcaaatgaaagagtttctagcccacttagggaaaaagataattgtttagaaaaccataaaatcaatggtaggaaaagttggaactggttacctggatgccatggttctctgttaaataaagtaagagaccaggtgtattctgagtgtcatcagtgttattttcagcatgctaataaatgtctttccggttatatatctatctaaattaacctttaaaatattggtttccttgataaaagcaccacttttgcttttgttagctgtaatattttttgtcatttagataagacctggtttggctctcaataaaagatgaagacagtagctctgtacagggatatatctatattagtcttcatctgatgaatgaagaaattttctcatattatgttcaagaaagtatttacttcctaaaaatagaattcccgattctgtctattttggttgaataccagaacaaatctttccgttgcaatcccagtaaaacgaaagaaaaggaatatcttacagactgttcatattagatgtatgtagactgttaatttgcaatttccccatatttcctgcctatcttacccagataactttctttgaaggtaaaagctgtgcaaaaggcatgagactcaggcctactctttgtttaaatgatggaaaaatataaattattttctaagtaataaaagtataaaaattatcattataaataaagtctaaagtttgaaattattaatttataaaagtgaactaattgtgtgattatcaaatcctgattaatgagaagtgaataatctaaaaatcatttatattctactgtgggaggtattcttggtgcttccatgtcagtatcgggctctccattgtcctcatcatttatagtacttctaaaataataatggaaacctcaataagggtcttgtcctcttctgtcatcctaaccctgattctagtttaatgcctttcctgacttatatgccatttgtaaataaacttcctttcaaactgttagaa

SEQ ID NO: 4882 - DNA, 3708 bp, Homo sapiens
ggtggacccccacgactctcccggcccttgcccgcggctcccggggggcggggcggggcgccccgggcggggtctgtgcgcaggcgcgtgagtgcgcgctctcgcgcaccggcgggcggggacgccccgtgaggcgccgccggaggaagcgcgcgcgcacctcacttccggcgcgcgctgcgccggcggcgattggacccgaggcggcgagctggcgccccgcccagccaatcggcggcgccggcgcgggtcggagggcgccgggcgcgcgcggggcggccgggggcgcgcggggcgcgggcggggcgccgggcggggcggggcggagcggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagca

SEQ ID NO: 4883 - DNA, 6332 bp, Homo sapiens
ggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacaggtgcagctgcagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcagatatttttaatgcttttcaatacatgttctaatgtagctgccaaacatgttgctcttctgaagtccccctggggctgggcagagccagcagagcctgcccccacttccccagcccctgccccaccccgcctcacaccttccccactctcaggctgttcttgaaacaccatgaggcttctgcgtgtagtccctgccccaaacttagcaagcacaggggcctccacagcccaggtggccccagaaaatgttccagagcccagcttggtacatagtgagatgctgctggggttggcctgaggtgggggccacttcctccaccccagtgggtatgtctgaggtcagccatggggatatctgggttgagattcaggttttggtgaatatggggcaggcgtccagatgtgtttgtgtcacctgctgcaacgctgtagccaatgaagattccagcgggatggcctgaccagcggggccggcactttggagccgtgggtgcagccaggtaccccgtgcagggcctgggaggctctccaggccacagtcctcagagcgtgttgggtcccatgttgtgtgtgggttccatgccctccacacagcaggagagggcttccctgaccacacctgccccctcagtcctgcttctccccagtaagcctgcactgtggggtctccataggaggagctggggaagctggggccctcccaggggtcctgatcgaccctgggggctcttggcctggtttcgtaagatggagcactgcaaaaggccatgctcagaaagcaaacgcagggcagggtgggcctcgagccggggctggaggggtctccacccttgctggcctgagagatggcccacatttcttacttgtgaccgccctgctcttcctggccgccccccccaggtggctgaacagggtgattttgttgtggtgaggggccaggatgtggcctggtgtgcagcctcagctccctgggttcaggcctcagaggtagcctgtgtgcaggaggcagagccccagcccctcccagccagagcccctccacaccagggactcctccttcacctgggaccaggagcctggggcacaccccagggtgggggagagggtaggaaggtctcccattgaatcctggcttcaggctctgccccgagaagtgtctgcggtgagggtgtgagccccgggctgatggcctctgaccccggcaacaggtgggaccctgactgactcgttcagctgcccccaagctgggctgcagagcatctgtttttctgctctccagtttcttttctttttttttttttttttttttgagatggagtcttgctctgttgcccaggctggagtgcagtggcatgatctcagctcactgcagcctccgtctcccaggttcaagcagttctcctgcctcagcctcccgagtagctgggattacaggcgtgtgccaccacacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggc

SEQ ID NO: 4884 - DNA, 3473 bp, Homo sapiens
ggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacaggtgcagctgcagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagaggaaaaagcattttcattttgactttaccctaagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcagatatttttaatgcttttcaatacatgttctaatgtagctgccaaa

SEQ ID NO: 4885 - DNA, 1182 bp, Homo sapiens
tcgcggagcgccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagcatcccgccgctgttgtccgctggggattttgtgcttctggggtcctgacctctttcacttgctgatctgtgggcgctcccacccgtgtgccagcgtgacggctcggggtgtccgctcccctctgggtcgaggccacagctgagtcacgttgctgctcgggctgctccctcggggggcccttgtccctcaacctgctctggtgccccactctcagcaccacagaatgatccgggttcaggttgcgttttccctgccaccaccctgcaatcagccacttctttaaggagctccagggctgcagccacgttagagggccccttggggggcagggccagctctacggttacatgcctgaaacagtcagaagggttggccaaatctcactaaatgcaaatttgaaacaa

SEQ ID NO: 4886 - DNA, 2742 bp, Homo sapiens
tcgcggagcgccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacagtggctcacacctgtattcccagctactcaggaggccagggtgggaggatcacttgagctcaggagttcaagaccagcctggacaaggcaacatagcgagaccctgtctctactaaaaatacagaacttagctgggtgtgtcgtgggcatctagagtcccagctacttgggaggctgaggtgggtggatcacttgggcccgggagctggaggctgcagtgagctgtgattgtgtcactgcactccagcctgggcaagcgagggagacttaaagcaattttttcttttgaaacggagtttcactcttgttgcccaggctggagtgcagtggtgcgatctcggctcaccgcaacctctgcctcctgggttcaagtgattctcctgcctcagctcccgagtagctgggattacagtcgcccaccaccatacctggctaattttttgtatttttagtaaagacagggtttcatggagaaaccaatatagaattgttcaggctggtctcgaactcccaacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttttttgtttttttttttttggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactatttt

SEQ ID NO: 4887 - DNA, 4803 bp, Homo sapiens
agagcggcggccggtcccgcgcggagcccggcgcccctccagcccgagccaggacgccgccggccccggtcccggccccgggcacgcagcgagccagggatgtgagcggcgccccgcggcatggcagcctcaggggtgcccagaggatgcgacatcctcatcgtctacagcccggatgccgaggaatggtgccagtacctgcagaccctgttcctgtccagtcggcaggtccgcagccagaagatactgactcacaggctgggccccgaggcctccttctcggcagaggacctaagccttttcctcagcacccgctgtgtcgtggtgctgctgtccgcggagctggtgcagcacttccacaagcccgccttgctgcccctgctgcagagagctttccatcctccgcaccgcgtggtcaggctgctctgcggcgtgcgggacagcgaggagttcctagacttctttccagattgggcccattggcaggagctcacctgtgacgatgagccagagacctacgtggcagctgtgaaaaaagccatttccgaagattctggctgtgactcagtcactgacactgagcctgaggacgagaaggttgtttcctactcgaagcagcagaacctgccgacggtgacttcacctgggaacctgatggtggtgcagccggaccgcattcgctgtggggcagaaaccactgtctatgttattgtgagatgtaagctggatgacagggtggcgacagaagcagagttttctcctgaggattctccctctgtaaggatggaagccaaggtggagaatgagtacaccatttcagtgaaggctcccaacctttcatctgggaacgtttctctgaagatatattctggagacttagtggtgtgtgaaaccgttatcagctattatactgacatggaagaaattgggaatttattgtccaatgccgcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacctggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcgtaacatggtaaagcctattaccagccaatgttgttagcatctttgtatgcacatcactgtttgtgcaatatatgaatattttgttgcattgtattcttatataaaaataagtagaaaacataaaattgaaattgctgatgagaa

SEQ ID NO: 4888 - DNA, 1766 bp, Homo sapiens
aaatggctcctgattggtaaattgcatctggaactgggaggatctgtacaggaactagaaatacttgaaagggacagcattctttgggctttcctgagggcattgactctggcatacctctcatggtgaccctggaagctccgcctctggagttgctatgagagaaattgctcttgtaggacatgaggtttttcaccagcgtggcctgctatggatcttgtctctttgcatctgagttgctgatcagatgcaaggactggctcaaaggaagaccagctctcttcactgccctgctagcttgtgtcctttatctttgtgagtggactggtgccaagcatgtcccagggtcatcttatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacctggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgta

SEQ ID NO: 4889 - DNA, 3151 bp, Homo sapiens
ataatgctgcccaggctggtctcaaactcctgagctcaagcaatcctcccgactcggcttcccaaagcacttggattacagattctggctgtgactcagtcactgacactgagcctgaggacgagaaggttgtttcctactcgaagcagcagaacctgccgacggtgacttcacctgggaacctgatggtggtgcagccggaccgcattcgctgtggggcagaaaccactgtctatgttattgtgagatgtaagctggatgacagggtggcgacagaagcagagttttctcctgaggattctccctctgtaaggatggaagccaaggtggagaatgagtacaccatttcagtgaaggctcccaacctttcatctgggaacgtttctctgaagatatattctggagacttagtggtgtgtgaaaccgttatcagctattatactgacatggaagaaattgggaatttattgtccaatgccgcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacctggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatc

SEQ ID NO: 4890 - DNA, 2467 bp, Homo sapiens
aaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcaccaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacgggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaaagactcca

SEQ ID NO: 4891 - DNA, 999 bp, Homo sapiens
gagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagaggtcagtagcttctcttctgggccctcttaggaggaggggaggaaggtacacaaagtcaaactttgtggctttcttacccaaaaggaagcaagatgttgaaaatcagctcaagatgtagagacttggtcctagtctttatctgctgaccttggacaaaccctttcctttggtgcctttacacctcacttaaaagccttgtgagggatgttcttgttccgcattttacaaatgaagaagcctctgtcagagacttgctcaaagtcacatagcctaggag

SEQ ID NO: 4892 - DNA, 2387 bp, Homo sapiens
agctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccgggcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcaccaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacgggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaatt

SEQ ID NO: 4893 - DNA, 2374 bp, Homo sapiens
agctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctggggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcaccaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacgggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaatt

SEQ ID NO: 4894 - DNA, 750 bp, Homo sapiens
cctcggttaaacactggtcgttcaatcacctgcaagacgaaggaggcaaggatgctgttggcctgggtacaagcattcctcgtcagcaacatgctcctagcagaagcctatggatctggagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcaccaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacaga

SEQ ID NO: 4895 - DNA, 3419 bp, Homo sapiens
aactcagtgctgcctgtcacacctgagccagcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggtgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagccccacgggaagagtacggctctaggcagctccagctggcagtgcctggagcctacgagaagccacagctcttgcccctgcagcctcccacagagccaggcctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccaggtgcctgtagtggctgtgttgggttccgggggtggaacccgagccatgtcttctctgtacggcagcctggcagggttgcaggagctcggccttctagacactgtgacctacctgagtggggtctctgggtctacctggtgcatctccacactctacagggacccagcctggtcccaggtggccttgcagggccccattgagcgtgcccaggttcacgtctgcagcagtaagatgggagctttgtccacggagcggctacagtactacactcaggaactgggggtccgggagcgcagtggccacagcgtgtccctcatcgacctctggggcctccttgttgagtatctcctgtaccaggaggagaaccctgccaagctgtctgaccaacaggaggcggtccgccagggtcagaacccttaccccatttacaccagtgtcaacgtccgcaccaacttgagtggggaagattttgcagagtggtgcgagttcacgccctatgaggttggcttccccaagtacggggcttatgttcccaccgagctcttcggctcagaactcttcatgggacgattgctgcagctccagcctgaaccccggatctgttacctgcaaggtatgtggggcagcgcctttgccaccagcctggatgagatcttcctaaagaccgccggctcgggcctcagcttcctggagtggtacagaggcagtgtgaatatcacagacgactgccagaagcctcagctgcacaacccctcgaggctgcgaacgaggctcctcaccccacaggggcccttctcccaggctgtgctggacatattcacctcccgcttcacttccgcccagagctttaacttcacccggggtctctgcttgcacaaggactatgtggctggcagggagttcgtggcctggaaagacacacacccggacgccttccccaaccagctcacccccatgcgggactgcctgtacctggtggacggaggctttgccatcaactctccgttcccactggctctgctgcctcagagagcagtggacctcattctgtcctttgactattccttggaagccccttttgaggtcttgaagatgacagagaagtactgcctggaccgaggaatccccttccctagcatcgaggtgggccctgaggacatggaggaggcccgtgagtgctatctgtttgccaaggctgaggacccccgctcccccattgtgctgcacttccccctggttaaccgtaccttccgcacacacctggccccaggtgtggagcgacaaacagctgaggagaaggcctttggggactttgtcatcaacaggccagacaccccctatggcatgatgaacttcacctatgagccccaggacttttatcggctggtggccctcagtcgatacaacgtcctgaacaacgtggagaccttgaagtgcgccctccagctggctctggaccggcaccaggctcgggagagggcaggggcctgaccaaggcaggaagcggaggactgtgacagagaggagacacactgctcatggtcagggcttgtagagggaggagcgatggggactctgtgcaggatctgcttcccttctctccaggacctgcctcgaggtgccccaggccccggaaagctcttgcagaattgcagcttggactggggcagggctctccttgtgtgtttttggagaagatgggcagtagatcgctccagggactcttggggatgtagggcagaagagaacagcactcatttcacagcggggtgtggagagaatcaggtgagccacagagcccaccccagacacagaaggacctcagagggcccaagtcctcagacccacacagaacaggggctgagggcactgagaagccagctgtcctccttacactgagatggaaagcagagatgcatccatccacacttcctgcagagcggcccaagccccaaccccacctcgagctcctggatgcactgctatcaagaacaatgaggggctgaggggatggccagcctatgttgctgactccatcatcctaaccctccttctgccttctggtctcctcgtgcctcctcccagatcacccttctcttcccagcgccctaaagcctgtggggtgatgtcccattctggctgctccaggtgggagatgtgcgcgtgtctccctgccagttacccaggcttcactcttcgaacctggaccacagtctctggtgatgtgtgtagtggccacatcatgcaaatatagtctcaccattcctaggagctaaatgggtgtgtctagtaggggcatcagttcatcgggggagaggtgtgcacctgtatgtggggcagg

SEQ ID NO: 4896 - DNA, 1457 bp, Homo sapiens
aactcagtgctgcctgtcacacctgagccagcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggcgggaaacctacccatactatgacctccaggtgaaggtgctgagggccacaaacatccggggcacagacctgctgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagccccacgggaagagtacggctctaggcagctccagctggcagtgcctggagcctacgagaagccacagctcttgcccctgcagcctcccacagagccaggcctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccaggtgcctgtagtggctgtgttgggttccgggggtggaacccgagccatgtcttctctgtacggcagcctggcagggttgcaggagctcggccttctagacactgtgacctacctgagtggggtctctgggtctacctggtgcatctccacactctacagggacccagcctggtcccaggtggccttgcagggccccattgagcgtgcccaggttcacgtctgcagcagtaaggtgggagatgtgcgcgtgtctccctgccagttacccaggcttcactcttcgaacctggaccacagtctctggtga

SEQ ID NO: 4897 - DNA, 3492 bp, Homo sapiens
aactcagtgctgcctgtcacacctgagccagcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggcgggaaacctacccatactatgacctccaggtgaaggtgctgagggccacaaacatccggggcacagacctgctgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagccccacgggaagagtacggctctaggcagctccagctggcagtgcctggagcctacgagaagccacagctcttgcccctgcagcctcccacagagccaggcctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccaggtgcctgtagtggctgtgttgggttccgggggtggaacccgagccatgtcttctctgtacggcagcctggcagggttgcaggagctcggccttctagacactgtgacctacctgagtggggtctctgggtctacctggtgcatctccacactctacagggacccagcctggtcccaggtggccttgcagggccccattgagcgtgcccaggttcacgtctgcagcagtaagatgggagctttgtccacggagcggctacagtactacactcaggaactgggggtccgggagcgcagtggccacagcgtgtccctcatcgacctctggggcctccttgttgagtatctcctgtaccaggaggagaaccctgccaagctgtctgaccaacaggaggcggtccgccagggtcagaacccttaccccatttacaccagtgtcaacgtccgcaccaacttgagtggggaagattttgcagagtggtgcgagttcacgccctatgaggttggcttccccaagtacggggcttatgttcccaccgagctcttcggctcagaactcttcatgggacgattgctgcagctccagcctgaaccccggatctgttacctgcaaggtatgtggggcagcgcctttgccaccagcctggatgagatcttcctaaagaccgccggctcgggcctcagcttcctggagtggtacagaggcagtgtgaatatcacagacgactgccagaagcctcagctgcacaacccctcgaggctgcgaacgaggctcctcaccccacaggggcccttctcccaggctgtgctggacatattcacctcccgcttcacttccgcccagagctttaacttcacccggggtctctgcttgcacaaggactatgtggctggcagggagttcgtggcctggaaagacacacacccggacgccttccccaaccagctcacccccatgcgggactgcctgtacctggtggacggaggctttgccatcaactctccgttcccactggctctgctgcctcagagagcagtggacctcattctgtcctttgactattccttggaagccccttttgaggtcttgaagatgacagagaagtactgcctggaccgaggaatccccttccctagcatcgaggtgggccctgaggacatggaggaggcccgtgagtgctatctgtttgccaaggctgaggacccccgctcccccattgtgctgcacttccccctggttaaccgtaccttccgcacacacctggccccaggtgtggagcgacaaacagctgaggagaaggcctttggggactttgtcatcaacaggccagacaccccctatggcatgatgaacttcacctatgagccccaggacttttatcggctggtggccctcagtcgatacaacgtcctgaacaacgtggagaccttgaagtgcgccctccagctggctctggaccggcaccaggctcgggagagggcaggggcctgaccaaggcaggaagcggaggactgtgacagagaggagacacactgctcatggtcagggcttgtagagggaggagcgatggggactctgtgcaggatctgcttcccttctctccaggacctgcctcgaggtgccccaggccccggaaagctcttgcagaattgcagcttggactggggcagggctctccttgtgtgtttttggagaagatgggcagtagatcgctccagggactcttggggatgtagggcagaagagaacagcactcatttcacagcggggtgtggagagaatcaggtgagccacagagcccaccccagacacagaaggacctcagagggcccaagtcctcagacccacacagaacaggggctgagggcactgagaagccagctgtcctccttacactgagatggaaagcagagatgcatccatccacacttcctgcagagcggcccaagccccaaccccacctcgagctcctggatgcactgctatcaagaacaatgaggggctgaggggatggccagcctatgttgctgactccatcatcctaaccctccttctgccttctggtctcctcgtgcctcctcccagatcacccttctcttcccagcgccctaaagcctgtggggtgatgtcccattctggctgctccaggtgggagatgtgcgcgtgtctccctgccagttacccaggcttcactcttcgaacctggaccacagtctctggtgatgtgtgtagtggccacatcatgcaaatatagtctcaccattcctaggagctaaatgggtgtgtctagtaggggcatcagttcatcgggggagaggtgtgcacctgtatgtggggcagg

SEQ ID NO: 4898 - DNA, 3498 bp, Homo sapiens
aactcagtgctgcctgtcacacctgagccagcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggcgggaaacctacccatactatgacctccaggtgaaggtgctgagggccacaaacatccggggcacagacctgctgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagccccacgggaagagtacggctctaggcagctccagctggcagtgcctggagcctacgagaagccacagctcttgcccctgcagcctcccacagagccaggcctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccagacccaggtgcctgtagtggctgtgttgggttccgggggtggaacccgagccatgtcttctctgtacggcagcctggcagggttgcaggagctcggccttctagacactgtgacctacctgagtggggtctctgggtctacctggtgcatctccacactctacagggacccagcctggtcccaggtggccttgcagggccccattgagcgtgcccaggttcacgtctgcagcagtaagatgggagctttgtccacggagcggctacagtactacactcaggaactgggggtccgggagcgcagtggccacagcgtgtccctcatcgacctctggggcctccttgttgagtatctcctgtaccaggaggagaaccctgccaagctgtctgaccaacaggaggcggtccgccagggtcagaacccttaccccatttacaccagtgtcaacgtccgcaccaacttgagtggggaagattttgcagagtggtgcgagttcacgccctatgaggttggcttccccaagtacggggcttatgttcccaccgagctcttcggctcagaactcttcatgggacgattgctgcagctccagcctgaaccccggatctgttacctgcaaggtatgtggggcagcgcctttgccaccagcctggatgagatcttcctaaagaccgccggctcgggcctcagcttcctggagtggtacagaggcagtgtgaatatcacagacgactgccagaagcctcagctgcacaacccctcgaggctgcgaacgaggctcctcaccccacaggggcccttctcccaggctgtgctggacatattcacctcccgcttcacttccgcccagagctttaacttcacccggggtctctgcttgcacaaggactatgtggctggcagggagttcgtggcctggaaagacacacacccggacgccttccccaaccagctcacccccatgcgggactgcctgtacctggtggacggaggctttgccatcaactctccgttcccactggctctgctgcctcagagagcagtggacctcattctgtcctttgactattccttggaagccccttttgaggtcttgaagatgacagagaagtactgcctggaccgaggaatccccttccctagcatcgaggtgggccctgaggacatggaggaggcccgtgagtgctatctgtttgccaaggctgaggacccccgctcccccattgtgctgcacttccccctggttaaccgtaccttccgcacacacctggccccaggtgtggagcgacaaacagctgaggagaaggcctttggggactttgtcatcaacaggccagacaccccctatggcatgatgaacttcacctatgagccccaggacttttatcggctggtggccctcagtcgatacaacgtcctgaacaacgtggagaccttgaagtgcgccctccagctggctctggaccggcaccaggctcgggagagggcaggggcctgaccaaggcaggaagcggaggactgtgacagagaggagacacactgctcatggtcagggcttgtagagggaggagcgatggggactctgtgcaggatctgcttcccttctctccaggacctgcctcgaggtgccccaggccccggaaagctcttgcagaattgcagcttggactggggcagggctctccttgtgtgtttttggagaagatgggcagtagatcgctccagggactcttggggatgtagggcagaagagaacagcactcatttcacagcggggtgtggagagaatcaggtgagccacagagcccaccccagacacagaaggacctcagagggcccaagtcctcagacccacacagaacaggggctgagggcactgagaagccagctgtcctccttacactgagatggaaagcagagatgcatccatccacacttcctgcagagcggcccaagccccaaccccacctcgagctcctggatgcactgctatcaagaacaatgaggggctgaggggatggccagcctatgttgctgactccatcatcctaaccctccttctgccttctggtctcctcgtgcctcctcccagatcacccttctcttcccagcgccctaaagcctgtggggtgatgtcccattctggctgctccaggtgggagatgtgcgcgtgtctccctgccagttacccaggcttcactcttcgaacctggaccacagtctctggtgatgtgtgtagtggccacatcatgcaaatatagtctcaccattcctaggagctaaatgggtgtgtctagtaggggcatcagttcatcgggggagaggtgtgcacctgtatgtggggcagg

SEQ ID NO: 4899 - DNA, 2690 bp, Homo sapiens
aactcagtgctgcctgtcacacctgagccagcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggcgggaaacctacccatactatgacctccaggtgaaggtgctgagggccacaaacatccggggcacagacctgctgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagccccacgggaagagtacggctctaggcagctccagctggcagtgcctggagcctacgagaagccacagctcttgcccctgcagcctcccacagagccaggcctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccaggtgcctgtagtggctgtgttgggttccgggggtggaacccgagccatgtcttctctgtacggcagcctggcagggttgcaggagctcggccttctagacactgtgacctacctgagtggggtctctgggtctacctggtgcatctccacactctacagggacccagcctggtcccaggtggccttgcagggccccattgagcgtgcccaggttcacgtctgcagcagtaagatgggagctttgtccacggagcggctacagtactacactcaggaactgggggtccgggagcgcagtggccacagcgtgtccctcatcgacctctggggcctccttgttgagtatctcctgtaccaggaggagaaccctgccaagctgtctgaccaacaggaggcggtccgccagggtcagaacccttaccccatttacaccagtgtcaacgtccgcaccaacttgagtggggaagattttgcagagtggtgcgagttcacgccctatgaggttggcttccccaagtacggggcttatgttcccaccgagctcttcggctcagaactcttcatgggacgattgctgcagctccagcctgaaccccggatctgttacctgcaaggtatgtggggcagcgcctttgccaccagcctggatgagatcttcctaaagaccgccggctcgggcctcagcttcctggagtggtacagaggcagtgtgaatatcacagacgactgccagaagcctcagctgcacaacccctcgaggctgcgaacgaggctcctcaccccacaggggcccttctcccaggctgtgctggacatattcacctcccgcttcacttccgcccagagctttaacttcacccggggtctctgcttgcacaaggactatgtggctggcagggagttcgtggcctggaaagacacacacccggacgccttccccaaccagctcacccccatgcgggactgcctgtacctggtggacggaggctttgccatcaactctccgttcccactggctctgctgcctcagagagcagtggacctcattctgtcctttgactattccttggaagccccttttgaggtcttgaagatgacagagaagtactgcctggaccgaggaatccccttccctagcatcgaggtgggccctgaggacatggaggaggcccgtgagtgctatctgtttgccaaggctgaggacccccgctcccccattgtgctgcacttccccctggttaaccgtaccttccgcacacacctggccccaggtgtggagcgacaaacagctgaggagaaggcctttggggactttgtcatcaacaggccagacaccccctatggcatgatgaacttcacctatgagccccaggacttttatcggctggtggccctcagtcgatacaacgtcctgaacaacgtggagaccttgaagtgcgcccaccccagacacagaaggacctcagagggcccaagtcctcagacccacacagaacaggggctgagggcactgagaagccagctgtcctccttacactga

SEQ ID NO: 4900 - DNA, 2573 bp, Homo sapiens
cccgggctgcggggcgcagcattgtgcggtcatggtgggccagatgtactgctaccccggcagccacctggcccgggcgctgacgcgggcgctggcgctggccctggtgctggccctgctggtcgggccgttcctgagcggcctggcgggggcgatcccagcgccggggggccgctgggcgcgcgatgggcaggtccctccagcctcccgcagccgctcggtgctcctggacgtctcggcgggccagctgcttatggtggacggacgccaccctgacgccgtggcctgggccaacctcaccaacgccatccgcgagactgggtgggccttcctggagctgggcacaagtggccaatacaatgacagcttgcaggcctatgcagccggtgtggtggaggctgctgtgtcggaggagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggggactacccgctggttcccggcaacaagctggtcttctcctcctaccccggcaccatcttctcctgcgacgacttctacatcctgggcagtgggctggtgacactggagaccaccattggcaacaagaacccagccctgtggaagtatgtgcggcccaggggctgtgtgctggagtgggtacgcaacatcgtggccaaccgcctggcctcggatggggccacctgggcagacatcttcaagaggttcaacagcggcacgtataacaaccagtggatgatcgtggactacaaggcgttcatcccgggtgggcccagccccgggagccgggtgcttaccatcctggagcagatccccggcatggtggtggtggctgacaagacctcggagctctaccagaagacctactgggccagctacaacataccgtccttcgagactgtgttcaatgccagtgggctgcaggccctagtggcccagtatggggactggttttcttatgacgggagcccccgggcccagatcttccggcggaaccagtcactggtacaagacatggactccatggtcaggctgatgaggtacaatgacttcctccatgaccctctgtcactgtgcaaagcctgcaacccccagcccaatggggagaatgctatctccgcccgctccgacctcaacccggccaatggctcctaccccttccaggccctgcgtcagcgctcccatgggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccccttcctcgtgcttctccttcctgagggtttgggaaggtcctggggcagactctggggctcccatggggtggaaggagcctgttccagcacccttctcccagctgcattcccacgggtggccctggagctggtgagctttgtctgggcgttgtcttcggctggcattgctcctcccagctctggcccctctgctccctcaggaagcagtcccctcgtctccctttctgggcagcttccttgaggacagaaacttgaaaacaaacacaaaccaaagtttctggccatctgtggctggagggttctgaatgtcctctctccatgtcaggcagagggtcagcccccatgcttctgcctcaggccccaccccaccccaccccaggcctgcccctcacctcagggccatacccacagcgccctgatggaggaaccagaccgcaggctgtgccaccattaaacaagagcggctgtggc

SEQ ID NO: 4901 - DNA, 2321 bp, Homo sapiens
gtgacccgggctgcggggcgcagcattgtgcggtcatggtgggccagatgtactgctaccccggcagccacctggcccgggcgctgacgcgggcgctggcgctggccctggtgctggccctgctggtcgggccgttcctgagcggcctggcgggggcgatcccagcgccggggggccgctgggcgcgcgatgggcaggtccctccagcctcccgcagccgctcggtgctcctggacgtctcggcgggccagctgcttatggtggacggacgccaccctgacgccgtggcctgggccaacctcaccaacgccatccgcgagactgggtgggccttcctggagctgggcacaagtggccaatacaatgacagcttgcaggcctatgcagccggtgtggtggaggctgctgtgtcggaggagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggggactacccgctggttcccggcaacaagctggtcttctcctcctaccccggcaccatcttctcctgcgacgacttctacatcctgggcagtgggctggtgacactggagaccaccattggcaacaagaacccagccctgtggaagtatgtgcggcccaggggctgtgtgctggagtgggtacgcaacatcgtggccaaccgcctggcctcggatggggccacctgggcagacatcttcaagaggttcaacagcggcaccggcatggtggtggtggctgacaagacctcggagctctaccagaagacctactgggccagctacaacataccgtccttcgagactgtgttcaatgccagtgggctgcaggccctagtggcccagtatggggactggttttcttatgacgggagcccccgggcccagatcttccggcggaaccagtcactggtacaagacatggactccatggtcaggctgatgaggtacaatgacttcctccatgaccctctgtcactgtgcaaagcctgcaacccccagcccaatggggagaatgctatctccgcccgctccgacctcaacccggccaatggctcctaccccttccaggccctgcgtcagcgctcccatgggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccccttcctcgtgcttctccttcctgagggtttgggaaggtcctggggcagactctggggctcccatggggtggaaggagcctgttccagcacccttctcccagctgcattcccacgggtggccctggagctggtgagctttgtctgggcgttgtcttcggctggcattgctcctcccagctctggcccctctgctccctcaggaagcagtcccctcgtctccctttctgggcagcttccttgaggacagaaacttgaaaacaaacacaaaccaaagtttctggccatctgtggctggagggttctgaatgtcc

SEQ ID NO: 4902 - DNA, 1906 bp, Homo sapiens
gtcaggcggggatacagcctggaaggtaatgcatgtccatggtacacaaattcacaagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgta

SEQ ID NO: 4903 - DNA, 745 bp, Homo sapiens
ctggctgagctgtgtggtgtgggggcacctgagggcggaggagccacctagaatataccccctgtcccagggctgagaaaagccaggcacaaagacctggggctccgctgacctcatccagcgctgcctttcttggggtgtctacagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgca

SEQ ID NO: 4904 - DNA, 873 bp, Homo sapiens
ggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtaatgcatgtccatggtacacaaattcacaaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggaacaccccacacagtgcccacttttgttctgccagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccct

SEQ ID NO: 4905 - DNA, 2115 bp, Homo sapiens
ctctttataatttagtttccatagaagttatatgtgcatttaaaaaaattcaatgctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgta

SEQ ID NO: 4906 - DNA, 1966 bp, Homo sapiens
ctgcgcgcggctaggaggggccgtcaggcggggatacagcctggaaggtgcgtgtggggctgggtctcggagtgggagacgtggagtgcagaacaccccacacagtgcccacttttgttctgccagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataact

SEQ ID NO: 4907 - DNA, 2180 bp, Homo sapiens
cggctaggaggggccgtcaggcggggatacagcctggaaggtgcgtgtggggctgggtctcggagtgggagacgtggagtgcaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggaacaccccacacagtgcccacttttgttctgccagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgta

SEQ ID NO: 4908 - DNA, 2104 bp, Homo sapiens
tgcgtgtggggctgggtctcggagtgggagacgtggagtgcaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgta

SEQ ID NO: 4909 - DNA, 1430 bp, Homo sapiens
atacagcctggaaggtgcgtgtggggctgggtctcggagtgggagacgtggagtgcagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctctctcccctgctctcccacctctacctccacccccaccggcctgacgctgtggccccgggacccagcagagctgggggagggatcagcccccaaagaaatgggggtgcatgctgggcctggccccctggcccacccccacttt

SEQ ID NO: 4910 - DNA, 1961 bp, Homo sapiens
agaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtgaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttc

SEQ ID NO: 4911 - DNA, 2007 bp, Homo sapiens
aggacaaagaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagagagctggagctgctggtgatgccaggctgccctgtgcagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtgaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcc

SEQ ID NO: 4912 - DNA, 2436 bp, Homo sapiens
ggtgatacgtttgtgccacatgaaacattctctgcctctgaaggctccagaggctgtgggaagcagcacatcagcgacagctcctggctgctggactccgcagggagggaaggaagattggtcgcaatgtcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcaca

SEQ ID NO: 4913 - DNA, 2729 bp, Homo sapiens
gtaggtgccgcaaggagccggcgagcggagcgcccgctcgggaccgcagccgccgggcgacgtcgccgccgcaccgggcacttctgtctccccggagcagctcctccagctcagtctccagctccacctccggctcccgctgggcctcccgctcgccctccgcgcccggctccccgcgcgcccgtcccgagtccgctgctcgccggcggccgcccggtcatgtcaggatggagatccggcagcacgagtggctctcggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcactcccagcagaagtgcatcgtgatctttgccctggtgtgctgctttgccattctggttgcactgatcttttcagccgtggacatcatgggagaggatgaggatggactctcagaaaaaaattgccaaaataaatgtcggtaagagaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcac

SEQ ID NO: 4914 - DNA, 2371 bp, Homo sapiens
cacctcgccctccctccttccgccccgcgcctcccgcgatcgccccctcccgcccggccgcgctcccagctggcgctcagcaccccgcgctccccgcgcccgctcgctcctccagctcctccagctcagtctccagctccacctccggctcccgctgggcctcccgctcgccctccgcgcccggctccccgcgcgcccgtcccgagtccgctgctcgccggcggccgcccggtcatgtcaggatggagatccggcagcacgagtggctctcggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcactcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttg

SEQ ID NO: 4915 - DNA, 2563 bp, Homo sapiens
ggcgtggctgtgggtcccggattagcggcggcatgggacggttgagttggcaggtggcggccgcggcggctgtgggcctggctctgactctggaggcgctgccttgggtgctgcgctggctgcggtccaggcggcggcggccgcggcgcgaggcgctgttcttcccgtctcaggtgacctgtaccgaggccctgctgcgggctccgggcgcggagctggccgagctccccgagggctgcccgtgcggcctgccccacggcgagagcgcgctaagccgcctgctgcgtgccctgctggccgcccgcgccagcctggatctctgcctgttcgccttctccagcccgcagctgggccgcgccgtgcagttgctgcaccagcgtggggtgcgagtgcgggtcgtcaccgactgcgactacatggccctcaacggctcgcaaatcggtctgctgcgcaaggcagggatccaggtccggcacgatcaagacccaggctacatgcatcacaagtttgccatcgtggacaagagggtgctcatcactggctcgctcaactggaccacgcaagccatccagaacaacagggagaatgttctcatcacggaggacgacgagtacgtgcggctttttctggaagaatttgagcgcatctgggaacagtttaaccctacaaagtatacctttttcccaccaaagaaaagtcacggaagctgtgccccacctgtctccagagctggagggagattgctttcatggcacagaacttgcggcacctccagcgaaagccaaacctaaccaagaatggggctgagccctccctgcgggctgctgtgcgttctgagggagggagacctcggcactagaaaaaaatcgttaaactaaagtctcgtctattagaatactaaattgaactaaagaaggttaggaaagggaaatttctgttacttcgggtcagttatttcgggccagacctttttcttgctcctttgccaaaataacttcagtcacgacctgccacggggtgctttcatgagtgtggtccgtatcttggtttggaatcgaaacttctgctacagcacagaaaaggcacagtgcctcttccaggtcgatcccattcccttccctgattctagaaaagtccctcctgctttggctgatgtgggccctttcagcatctccctgagatttcatccctctctccatgtggcacgactggggttggttggggcctacagtctccttgtccctcacagtctgcccctgtcagggctcggtcctcagagtaaggaaaggaaatggaagtcaggaggaagggaagatgtgagtgtgcggtgcgggtggcaaaagcagccttcggggcaaccccgtgagcgtcattgccaccaaaggctggctgttcccttgattccttgcataattgctctttaaaaccagtatgcacgccagtgccaagctcttcagcagcctgtccttgggtagtaagtgctgtggtctgtcaggactgatggccagcagctgtttctatgttgggcttttaactttttttattttatttatttatttatttatcttttttgagatggagtctcactctgtggcccaggctggagtgcagtggcacaacctcggctcactgcatcctctgcctcctgggttcaaacgattgtcctgcctcagcctcccgagtagctgggattacaggtgcctgccacaacacctggctgattttttttttggtatttttagtagagacagggtttcaccatgttggttaggctggtctcaaactcctgacctcaagtgatccaccacttccgcctcccaaagtgctgggattacaggtgtgagccgccatgcccggccgggcttttaacttttaatgtcctaatgttaaggtaattttgttgtgtgtttagaagtgaccttacctttaacacctgtggagttagtgcgtgcacattgctggctcagcgtaacccatcacgggaccggaggagaggagagcggggaagaggagagcagcttcaggccgtggtgtctcccacgtctgtgttcttatttgcagctcagggtttgcattcccaggtagaacaggtgtcgtacactgtgaaatgttccaggttatttgtttataatgtgtgtgtcatatacagatagctccgatgacatctgaagttgtgacttcatcatcttgtcatatttctgtatgatgagccccagggcccatcctgaggtctgctagccatgtgcttagtctcacctccccagcccacgctggcattaccacccagagacccttcagtgctgtgtgtttttcctttttagggttacttttgactcacagtgttaggcaagccagcttggaagttaacttttaaaaaaattcaattgaagctgtaaagtataatatatagattggaagtcaccagaaattgttttagtttgtgaattcccccagtgtatgttctgaaaagaaaatgggagagcttgtaaagcatctcctaaatgcgaagccgcgtgaccctggacttctggcacatctgaataaacatgttcttattctggaa

SEQ ID NO: 4916 - DNA, 1031 bp, Homo sapiens
gactccgctgcggcggcgtggctgtgggtcccggattagcggcggcatgggacggttgagttggcaggtggcggccgcggcgcgaggcgctgttcttcccgtctcaggtgacctgtaccgaggccctgctgcgggctccgggcgcggagctggccgagctccccgagggctgcccgtgcggcctgccccacggcgagagcgcgctaagccgcctgctgcgtgccctgctggccgcccgcgccagcctggatctctgcctgttcgccttctccagcccgcagctgggccgcgccgtgcagttgctgcaccagcgtggggtgcgagtgcgggtcgtcaccgactgcgactacatggccctcaacggctcgcaaatcggtctgctgcgcaaggcagggatccaggtccggcacgatcaagacccaggctacatgcatcacaagtttgccatcgtggacaagagggtgctcatcactggctcgctcaactggaccacgcaagccatccagaacaacagggagaatgttctcatcacggaggacgacgagtacgtgcggctttttctggaagaatttgagcgcatctgggaacagtttaaccctacaaagtatacctttttcccaccaaagaaaagtcacggaagctgtgccccacctgtctccagagctggagggagattgctttcatggcacagaacttgcggcacctccagcgaaagccaaacctaaccaagaatggggctgagccctccctgcgggctgctgtgcgttctgagggagggagacctcggcactagaaaaaaatcgttaaactaaagtctcgtctattagaatactaaattgaactaaagaaggttaggaaagggaaatttctgttacttcgggtcagttatttcgggccagacctttttcttgctcctttgccaaaataacttcagtcacgacctgccacggggtgctttcatgagtgtggtccgtatcttggtttggaatcgaaacttctgctacagcacagaaaaggcacagtgcctcttc

SEQ ID NO: 4917 - DNA, 2131 bp, Homo sapiens
gttcccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcacccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtca

SEQ ID NO: 4918 - DNA, 2178 bp, Homo sapiens
gttcccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcacccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtc

SEQ ID NO: 4919 - DNA, 539 bp, Homo sapiens
acacgcgagtctgataagcaccctcccccggaatcatgcggtgctgtgaggcctagcgaagatgaagatagaatgcaagagtctcactctatcgcccaggctggagtgcaatggtgccatctcagctcactgcaacctccccttcccaagttcaagcaattttcatgccgcagcctcctagctgggattacagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtct

SEQ ID NO: 4920 - DNA, 739 bp, Homo sapiens
gatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggacagagtctcgttctgtcgcccaggctggagtgcagtggtgtgatctcggctcacttcaacctccgcctacagggttcaagggattctcctgcctcagcctcctgagtatctgggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtct

SEQ ID NO: 4921 - DNA, 744 bp, Homo sapiens
aagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggacagagtctcgttctgtcgcccaggctggagtgcagtggtgtgatctcggctcacttcaacctccgcctacagggttcaagggattctcctgcctcagcctcctgagtatctgggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaat

SEQ ID NO: 4922 - DNA, 633 bp, Homo sapiens
gatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaat

SEQ ID NO: 4923 - DNA, 826 bp, Homo sapiens
agtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtc

SEQ ID NO: 4924 - DNA, 555 bp, Homo sapiens
tcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggggaaggaacagaagagtgtcgtctcctagaaatctagcactggagaaacgaggaaaattcttccagcgatggtctcccactcagagctgaggaagctttt

SEQ ID NO: 4925 - DNA, 1409 bp, Homo sapiens
tttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaaggaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaa

SEQ ID NO: 4926 - DNA, 1705 bp, Homo sapiens
ggtggtcggactgtcagcctcgccttctattctttgatttccagtaacttattttcgaaagattgctggagggaaaggctcaacgtctcttttgggattttcctaagcagaaagacctcatcctaacaaaactgaggcgccaatcctactggctggcaactttcggcagggagggtgattctatttgaagatcaatcctaactctgggaccccttgggaatgtccaggagctaggaacgcagcgccgcggtctctccagcctctggtccctgggagcaagcagggcaccggtggagcaggtgcctctggggccgcacggaaacccagctaggccagttcctccactgcgccggtaggcggcggagacgctgcgcgtgcgcgcagggcagacggtagagcggagacgacgctcccagactcctccggtctccccgggcagcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaaggtaatcaggaagccttctcagagatgacatttaagcaaagatgggtaagagcgaaccatgcagctatctggaggatcattctaggcaatgaacacatcaagtgcagaagcgcaaaggttggctggttgcagtgttgcagaatcgagaagaggccattgagcacggggtgagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaa

SEQ ID NO: 4927 - DNA, 2197 bp, Homo sapiens
gtgcgcgcagggcagacggtagagcggagacgacgctcccagactcctccggtctccccgggcagcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggtaaacttccagtgtaaatttaatgtaaatgagaaggaacaactttttgtaggaagatcttttgagccgaatataaaatgtgagtgaaacgggagatgcgttgtcattggcttggcctctcaccagcactcactgctgacagctcatgccggctgggcaaagccgattgttaaactttcaaaagtgttggagcctgttgatggtttgttggtaggaatgtttacatcacagaaattggcaaacactacagataggtctggggtttttttctgggagagtcaattattagacattcaccagcatatcaccgcctagctggaacccagtttaccactggatctgatttggttggactctcttgtagggaagaataacaaacagaaaagccgcttaaacttttcttttagtcctttcaaatacatgtgacctattctttagccatttattttataaaactatgtgacttctaataacaatgtctgtattaacataggacacagacagaattatttgttcaactaacattcttcataaaactgatcagacactccgaaggattgtatctcagacaatgaaggaagcaaaaggtatgatgtgtcagttatgtgttgagttggtatgattgtgactttctactgctactgttattcccgacactcagagtttattagttttcagtcataaaagttcacatcatgttttcaatttaattatgcaatttgactaaatgtaactaaaaattctacctctggaactgagtgttcatccatccaacaaatttttactgagttgccttactgtactaggccttactctagatgctggggaatcggcagggagcagaacattctaatgaggagacagacaaaacatgattacatgagtatatgcccatgctctgaagaaaatttaagtaaggtaaggcagtgtagtgatgggaggatttatttttaaaaaggtaatcaggaagccttctcagagatgacatttaagcaaagatgggtaagagcgaaccatgcagctatctggaggatcattctaggcaatgaacacatcaagtgcagaagcgcaaaggttggctggttgcagtgttgcagaatcgagaagaggccattgagcacggggtgagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaatc

SEQ ID NO: 4928 - DNA, 1098 bp, Homo sapiens
gcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaatc

SEQ ID NO: 4929 - DNA, 7833 bp, Homo sapiens
atggagccgcacgtgctcggcgcggtcctgtactggctgctgctgccctgcgcgctgctggctgcctgcctgctccgcttcagcggactctcgctggtctacctgctcttcctgctgctgctgccctggttccccggccccacccgatgcggcctccaaggtcacacaggccgcctcctgcgggcattgctgggcctcagcctgctcttcctggtggcccatctcgccctccagatctgcctgcatattgtgccccgcctggaccagctcctgggacccagctgcagccgctgggagaccctctcgcgacacataggggtcacaaggctggacctgaaggacatccccaacgccatccggctggtggcccctgacctgggcatcttggtggtctcctctgtctgcctcggcatctgcgggcgccttgcaaggaacacccggcagagcccacatccacgggagctggatgatgatgagagggatgtggatgccagcccgacggcagggctgcaggaagcagcaacgctggcccctacacggaggtcacggctggccgctcgtttccgagtcacggcccactggctgctggtggcggctgggcgggtcctggccgtaacactgcttgcactggcaggcatcgcccacccctcggccctctccagtgtctacctgctgctcttcctggccctctgcacctggtgggcctgccactttcccatcagcactcggggcttcagcagactctgcgtcgcggtggggtgcttcggcgccggccatctcatctgcctctactgctaccagatgcccttggcacaggctctgctcccgcctgccggcatctgggctagggtgctgggtctcaaggacttcgtgggtcccaccaactgctccagcccccacgcgctggtcctcaacaccggcctggactggcctgtgtatgccagccccggcgtcctcctgctgctgtgctacgccacggcctctctgcgcaagctccgcgcgtaccgcccctccggccagaggaaggaggcggcaaaggggtatgaggctcgggagctggagctagcagagctggaccagtggccccaggaacgggagtctgaccagcacgtggtgcccacagcacccgacaccgaggctgataactgcatcgtgcacgagctgaccggccagagctccgtcctgcggcggcctgtgcggcccaagcgggctgagcccagggaggcgtctccgctccacagcctgggccacctcatcatggaccagagctatgtgtgcgcgctcattgccatgatggtatggagcatcacctaccacagctggctgaccttcgtactgctgctctgggcctgcctcatctggacggtgcgcagccgccaccaactggccatgctgtgctcgccctgcatcctgctgtatgggatgacgctgtgctgcctacgctacgtgtgggccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcccacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtgtccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggaggactccagggacgaggggctgggcgtggccactccccaccaggccacgcaggtgcctgaaggggcagccaagtggggcctggtggctgagcggctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgactttcaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgggctgggcgcggaggagccactcagcagcatgacagacgacatgggcagccccctgagcaccggctaccacacgcgcagtggcagtgaggaggcagtcaccgaccccggggagcgtgaggctggtgcctctctgtaccagggactgatgcggacggccagcgagctgctcctggacaggcgcctgcgcatcccagagctggaggaggcagagctgtttgcggaggggcagggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagccagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccactgctcttcatgtcgctggtgcgctccgtggttggggttgtcaaccagcccatcgatgtcaccgtcaccctgaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccctaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaatcaga

SEQ ID NO: 4930 - DNA, 1631 bp, Homo sapiens
taccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggttcatgaagatttgcccgttttcttctaaaagttctatagttttagctctgaagtttcgctctttgatccactttgagaaatacccgcagcccaaagggcagaagaagaagaagatcgtcaagtacggcatgggtggcctcatcatcctcttcctcatcgccatcatctggttcccactgctcttcatgtcgctggtgcgctccgtggttggggttgtcaaccagcccatcgatgtcaccgtcaccctgaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccctaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaagcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatgg

SEQ ID NO: 4931 - DNA, 7661 bp, Homo sapiens
cacaggccgcctcctgcgggcattgctgggcctcagcctgctcttcctggtggcccatctcgccctccagatctgcctgcatattgtgccccgcctggaccagctcctgggacccagctgcagccgctgggagaccctctcgcgacacataggggtcacaaggctggacctgaaggacatccccaacgccatccggctggtggcccctgacctgggcatcttggtggtctcctctgtctgcctcggcatctgcgggcgccttgcaaggaacacccggcagagcccacatccacgggagctggatgatgatgagagggatgtggatgccagcccgacggcagggctgcaggaagcagcaacgctggcccctacacggaggtcacggctggccgctcgtttccgagtcacggcccactggctgctggtggcggctgggcgggtcctggccgtaacactgcttgcactggcaggcatcgcccacccctcggccctctccagtgtctacctgctgctcttcctggccctctgcacctggtgggcctgccactttcccatcagcactcggggcttcagcagactctgcgtcgcggtggggtgcttcggcgccggccatctcatctgcctctactgctaccagatgcccttggcacaggctctgctcccgcctgccggcatctgggctagggtgctgggtctcaaggacttcgtgggtcccaccaactgctccagcccccacgcgctggtcctcaacaccggcctggactggcctgtgtatgccagccccggcgtcctcctgctgctgtgctacgccacggcctctctgcgcaagctccgcgcgtaccgcccctccggccagaggaaggaggcggcaaaggggtatgaggctcgggagctggagctagcagagctggaccagtggccccaggaacgggagtctgaccagcacgtggtgcccacagcacccgacaccgaggctgataactgcatcgtgcacgagctgaccggccagagctccgtcctgcggcggcctgtgcggcccaagcgggctgagcccagggaggcgtctccgctccacagcctgggccacctcatcatggaccagagctatgtgtgcgcgctcattgccatgatggtatggagcatcacctaccacagctggctgaccttcgtactgctgctctgggcctgcctcatctggacggtgcgcagccgccaccaactggccatgctgtgctcgccctgcatcctgctgtatgggatgacgctgtgctgcctacgctacgtgtgggccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcccacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtgtccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggaggactccagggacgaggggctgggcgtggccactccccaccaggccacgcaggtgcctgaaggggcagccaagtggggcctggtggctgagcggctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgactttcaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgggctgggcgcggaggagccactcagcagcatgacagacgacatgggcagccccctgagcaccggctaccacacgcgcagtggcagtgaggaggcagtcaccgaccccggggagcgtgaggctggtgcctctctgtaccagggactgatgcggacggccagcgagctgctcctggacaggcgcctgcgcatcccagagctggaggaggcagagctgtttgcggaggggcagggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagccagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccactgctcttcatgtcgctggtgcgctccgtggttggggttgtcaaccagcccatcgatgtcaccgtcaccctgaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccctaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatgga

SEQ ID NO: 4932 - DNA, 3443 bp, Homo sapiens
atgcctgactacagaactcgagctctcttcgtgcaaagtactctcggggactctgcaggacctgagctgcagttgctcagcatagtgcccggccgggatctgcagccaagcgattcattcacagcctcctcctcaccaccaccatctgtgtggtcagaacttgagcacatccgtggaaaatcagaagcaaccacagagctaaaaagacccagccttccagggagtattcattcctgcctatgtggggtgtggtgtggcgtggggaagagaacccccagctccttggtgtccagcttgcaggaccttgagctccttggccagaggcagcgacagctgtggatggagtcgacgcctcggccgccctataatccattcctcgtgccctgcacacccgtggggaaactcagtgcagagcatggaggtcccacccgaaagatgccccccagcgccagtgccgtggacttcttccagctctttgtcccagacaacgtcctcaagaacatggtggtgcagacaaacatgtatgccaagaagttccaggagcggtttgggagcgacggagcctgggtggaggtgacgctgacggagatgaaggcgttcctgggctacatgatctccaccagcatctcccactgcgagtccgtcctcagcatctggagcggaggcttctacagcaaccgcagcctcgccctcgtcatgagccaggcccgcttcgagaagatcctcaagtacttccacgtcgtggccttccgctccagccagaccacgcacgggctctacaaggtccagcccttcctcgactccctgcagaacagcttcgactctgccttcaggccttcccaaacccaggtgctacatgaacccctgatcgatgaggatcctgtattcattgccacgtgcacagagcgggagctgcgaaagaggaaaaagcggaaattcagcctctgggtcagacaatgttcttccactggcttcatcatccagatttatgtccacctgaaggaaggtgggggcccagatggcctggatgcgctgaagaataagccccagctccacagcatggtggccaggagcctgtgccggaacgcggcaggcaagaactacatcattttcacggggcccagcatcaccagcctgacgctgtttgaagagtttgagaagcaagggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctcatttgcattccaagaagagcatgtcctccctcgagaaacagtgccgccggtgtgatgagcacttacacccacgttctcaagggcagattctctcatgacatccgtggagcttgcgaggcagcgtggactggtgactgtgaaggaaggcccccgtggtagaatgagctggagcacgctctaagagagatgcctgcttcctaaagatctacagcaatctgggacgtggttcaagttcaagacttgaaggaagcaaagacgccctgcatggttacaatggctcaggtgtcaggggaggccggagggttttccagcatttgcctcatgccagcacctttgaaccggtctcttagaagaagacacacatcctgggtgtacagtggtgaaatggggagtgggtgcccattctgaaaaacgaggcattcctgctcattccctctgcttagctggtgggcaggggagagagggaaatgccaaaaacttggagtgaaggatgatgctattttttatttttaaatatatcttcaggttattttcttactgttgcttcagatctaatgtaaaaggcagatgtcccctcctctccacccccgacgctgaccccggcctcagtcacggctctttgcatgatcacagttctgtgttctggcctgtggcagggccgggaagggccgctggcttccgaacagacgtggttgctctccacgaggcgcatggggagcccgcgggccctaagctttgtcgcagatgtcatcattggcagaattacttgtcttgaaaaataagtagcattgctgaaacacacaaccgaattctctacgatggccatttgctcattgtctttcctctgtgtgtagtgagtgaccctggcagtgtttgcctgctcagagtggcccctcagaacaacagggctggccttggaaaaaccccaaaacaggactgtggtgacaactctggtcaggtgtgatttgacatgagggccggaggcggttgctgacggcaggactggagaggctgcgtgcccggcactggcagcgaggctcgtgtgtcccccaggcagatctgggcactttcccaacccaggtttatgcgtctccagggaagcctcggtgccagagtggtgggcagatctgaccatccccacagaccagaaacaaggaatttctgggattacccagtcccccttcaacccagttgatgtaaccacctcattttttacaaatacagaatctattctactcaggctatgggcctcgtcctcactcagttattgcgagtgttgctgtccgcatgctccgggccccacgtggctcctgtgctctagatcatggtgactcccccgccctgtggttggaatcgatgccacggattgcaggccaaatttcagatcgtgtttccaaacacccttgctgtgccctttaatgggattgaaagcacttttaccacatggagaaatatatttttaatttgtgatgcttttctacaaggtccactatttctgagtttaatgtgtttccaacacttaaggagactctaatgaaagctgatgaattttcttttctgtccaaacaagtaaaataaaaataaaagtctatttagatgttg

SEQ ID NO: 4933 - DNA, 1569 bp, Homo sapiens
gggcacctgttcggtaggtcagatatgcctgactacagaactcgagctctcttcgtgcaaagtactctcggggactctgcaggacctgagctgcagttgctcagcatagtgcccggccgggatctgcagccaagcgattcattcacaggtcccacccgaaagatgccccccagcgccagtgccgtggacttcttccagctctttgtcccagacaacgtcctcaagaacatggtggtgcagacaaacatgtatgccaagaagttccaggagcggtttgggagcgacggagcctgggtggaggtgacgctgacggagatgaaggcgttcctgggctacatgatctccaccagcatctcccactgcgagtccgtcctcagcatctggagcggaggcttctacagcaaccgcagcctcgccctcgtcatgagccaggcccgcttcgagaagatcctcaagtacttccacgtcgtggccttccgctccagccagaccacgcacgggctctacaaggtccagcccttcctcgactccctgcagaacagcttcgactctgccttcaggccttcccaaacccaggtgctacatgaacccctgatcgatgaggatcctgtattcattgccacgtgcacagagcgggagctgcgaaagaggaaaaagcggaaattcagcctctgggtcagacaatgttcttccactggcttcatcatccagatttatgtccacctgaaggaaggtgggggcccagatggcctggatgcgctgaagaataagccccagctccacagcatggtggccaggagcctgtgccggaacgcggcaggcaagaactacatcattttcacggggcccagcatcaccagcctgacgctgtttgaagagtttgagaagcaagggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctca

SEQ ID NO: 4934 - DNA, 4866 bp, Homo sapiens
ggctcgaagtggggaccctcgccccgtcctcggctgtccagtcctcctcctcgcagaccccggcggttcctaccccaggccgcaggggagacggggccccaaggcaggcctctgcaatgtcaccgcctctgtgtcccctccttctcctggctgtgggcctgcggctggctggaactctcaaccccagtgatcccaatacctgcagcttctgggaaagcttcactaccaccaccaaggagtcccactcccgccccttcagcctgctcccctcagagccctgcgagcggccctgggagggcccccatacttgcccccagcccacggttgtataccggaccgtgtaccgtcaggtggtgaagacggaccaccgccagcgcctgcagtgctgccatggcttctatgagagcagggggttctgtgtcccgctctgtgcccaggagtgtgtccatggccgttgtgtggcacccaatcagtgccaatgtgtgccaggctggcggggcgacgactgttccagtgagtgtgccccaggaatgtgggggccacagtgtgacaagccctgcagctgcggcaacaacagctcgtgtgatcccaagagtggggtatgttcttgcccttctggtctgcagcccccgaactgccttcagccctgtacccctggctactatggccctgcctgccagttccgctgccagtgccatggggcaccctgcgatccccagactggagcctgcttctgccccgcagagagaactgggcccagctgtgacgtgtcctgttcccagggcacttctggcttcttctgccccagcacccattcttgccaaaatggaggtgtcttccaaaccccacagggctcctgcagctgcccccctggctggatgggcaccatctgctccctgccctgcccagagggctttcacggacccaactgctcccaggaatgtcgctgccacaacggcggcctctgtgaccgattcactgggcagtgccgctgcgctccgggttacactggggatcggtgccgggaggagtgcccggtgggccgctttgggcaggactgtgctgagacgtgcgactgcgccccggacgcccgttgcttcccggccaacggcgcatgtctgtgcgaacacggcttcactggggaccgctgcacggatcgcctctgccccgacggcttctacggtctcagctgccaggccccctgcacctgcgaccgggagcacagcctcagctgccacccgatgaacggggagtgctcctgcctgccgggctgggcgggcctccactgcaacgagagctgcccgcaggacacgcatgggccagggtgccaggagcactgtctctgcctgcacggtggcgtctgccaggctaccagcggcctctgtcagtgcgcgccgggttacacgggccctcactgtgctagtctttgtcctcctgacacctacggtgtcaactgttctgcacgctgctcatgtgaaaatgccatcgcctgctcacccatcgacggcgagtgcgtctgcaaggaaggttggcagcgtggtaactgctctgtgccctgcccacccggaacctggggcttcagttgcaatgccagctgccagtgtgcccatgaggcagtctgcagcccccaaactggagcctgtacctgcacccctgggtggcatggggcccactgccagctgccctgtccgaaggggcagtttggagaaggttgtgccagtcgctgtgactgtgaccactctgatggctgtgaccctgttcatggacgctgtcagtgccaggctggctggatgggtgcccgctgccacctgtcctgccctgagggcttatggggagtcaactgtagcaacacctgcacctgcaagaatgggggcacctgtctccctgagaatggcaactgcgtgtgtgcacccggattccggggcccctcctgccagagatcctgtcagcctggccgctatggcaaacgctgtgtgccctgcaagtgcgctaaccactccttctgccacccctcgaacgggacctgctactgcctggctggctggacaggccccgactgctcccagccatgccctccaggacactggggagaaaactgtgcccagacctgccaatgtcaccatggtgggacctgccatccccaggatgggagctgtatctgccccctaggctggactggacaccactgcttagaaggctgccctctggggacatttggtgctaactgctcccagccatgccagtgtggtcctggagaaaagtgccacccagagactggggcctgtgtatgtcccccagggcacagtggtgcaccttgcaggattggaatccaggagccctttactgtgatgccgaccactccagtagcgtataactcgctgggtgcagtgattggcattgcagtgctggggtcccttgtggtagccctggtggcactgttcattggctatcggcactggcaaaaaggcaaggagcaccaccacctggctgtggcttacagcagcgggcgcctggacggctccgagtatgtcatgccagatgtccctccgagctacagtcactactactccaaccccagctaccacaccctgtcgcagtgctccccaaaccccccaccccctaacaaggttccaggcccgctctttgccagcctgcagaaccctgagcggccaggtggggcccaagggcatgataaccacaccaccctgcctgctgactggaagcaccgccgggagccccctccagggcctctggacagggggagcagccgcctggaccgaagctacagctatagctacagcaatggcccaggcccattctacaataaagggctcatctctgaagaggagctcggggccagtgtggcttccctgagcagtgagaacccatatgccaccatccgggacctgcccagcttgccagggggcccccgggagagcagctacatggagatgaaaggccctccctcaggatctccccccaggcagcctcctcagttctgggacagccagaggcggcggcaaccccagccacagagagacagtggcacctacgagcagcccagccccctgatccatgaccgagactctgtgggctcccagccccctctgcctccgggcctaccccccggccactatgactcacccaagaacagccacatccctggacattatgacttgcctccagtacggcatcccccatcacctccacttcgacgccaggaccgttgaggagccaggatggtatggcagaggccagcacacctggctgttgctgctcaaggctggggacagagcctagtgtacccctgccaggagcagggagtggaccggcaggctgtgaacatgaacaacgcttaacagagcaagtgatgggagccttgttcctgggttctaccatgggagacgctgatcagcaggatgcctggctccctttcccaacccactgctcccaaggcctccagggccctgtgtacataaactggtgggttggaagttgctgggtaactctgatttcagacatgcgtgtggggtaccttttctgtgcatgctcagcctgggctctgtgcgtgtgtgtgtttctgtgattttagaagggtaccaggcacaggttctgtcctagggcacttaccatttagtagggagatggaaccaacccaattaactctagcaatagcctcctaactggcctcctccattgattcagtgaaccttccaatgcatggctcataatttcaaaatacaggctggttagttactccctacctgaaagccttcataggtgcctctttgctcttctgccagtatcaaaacttttgaaggccttaaaggccctgctttgcctggcccatctgtctctccagcctcaccttgaactgtgttcctgtcactgcacgccagtcacaccggcctctaggtcctcctgtaggccactcttctttctggcacagggacctgcacacctggagtgcccttcctcccccactcgcctgttcacccctgcttttcctttacacctcctcctcagggaagtgcccaccctccgtacatctttcacagccctgattgcagctgtgttcactcaccaggtacctgcagaaggcctacagggtgccaggcacttctttaatgtgttctttctttatgtgattatttgattaatctctgcctcccccactagactgtaagctccctgaaggcaagaatcctgtgcttatgctcaatattagctctcccttggcacagagtaggcactcaacaaatgctccccaaaaggctgagtggctgactgaattaagtaccagtgacatgcagtaactgctaagatagatgagccatctgtatgctctgacagttacagactgaataagttggagacttccctaaagggtggcatttccccagggtaacaacgcagagctcaggtgtgggaaggtgccaggggcaggggtgcagaggggctgaggctgaggggggtgcagaggctggagaaaggataacaggagagagtatacaggcatgccttgatttattgcacttcacaggtagcagaatttttaaagaaattgaaggttttgggacatatatgtgacagcaataggttaagaaaagcaaagcagagaaattgaagatttgtgtcaacactgctttaagcaaatctgttggcaccatttttccaatagcatgtgcccattttgggtctctacattgcattttggtaattgcttgcaatatttcaagcattttcattgttattatatgtgttatagtgatctgtgatcagtgatctttgatatattattgtaattgtttcggggcgccatgaaccgcacccatataacacggtaaacttaatcagcaaacgttg

SEQ ID NO: 4935 - DNA, 4970 bp, Homo sapiens
agtcaggctggggctcgaagtggggaccctcgccccgtcctcggctgtccagtcctcctcctcgcagaccccggcggttcctaccccaggccgcaggggagacggggccccaaggcaggcttcatatcctgaacgctgggatcccccaggacattccctggcccccaggccccaggtcccaggccccagggctgagctgtgggcaggccccacctggcctctgcaatgtcaccgcctctgtgtcccctccttctcctggctgtgggcctgcggctggctggaactctcaaccccagtgatcccaatacctgcagcttctgggaaagcttcactaccaccaccaaggagtcccactcccgccccttcagcctgctcccctcagagccctgcgagcggccctgggagggcccccatacttgcccccagcccacggttgtataccggaccgtgtaccgtcaggtggtgaagacggaccaccgccagcgcctgcagtgctgccatggcttctatgagagcagggggttctgtgtcccgctctgtgcccaggagtgtgtccatggccgttgtgtggcacccaatcagtgccaatgtgtgccaggctggcggggcgacgactgttccagtgagtgtgccccaggaatgtgggggccacagtgtgacaagccctgcagctgcggcaacaacagctcgtgtgatcccaagagtggggtatgttcttgcccttctggtctgcagcccccgaactgccttcagccctgtacccctggctactatggccctgcctgccagttccgctgccagtgccatggggcaccctgcgatccccagactggagcctgcttctgccccgcagagagaactgggcccagctgtgacgtgtcctgttcccagggcacttctggcttcttctgccccagcacccattcttgccaaaatggaggtgtcttccaaaccccacagggctcctgcagctgcccccctggctggatgggcaccatctgctccctgccctgcccagagggctttcacggacccaactgctcccaggaatgtcgctgccacaacggcggcctctgtgaccgattcactgggcagtgccgctgcgctccgggttacactggggatcggtgccgggaggagtgcccggtgggccgctttgggcaggactgtgctgagacgtgcgactgcgccccggacgcccgttgcttcccggccaacggcgcatgtctgtgcgaacacggcttcactggggaccgctgcacggatcgcctctgccccgacggcttctacggtctcagctgccaggccccctgcacctgcgaccgggagcacagcctcagctgccacccgatgaacggggagtgctcctgcctgccgggctgggcgggcctccactgcaacgagagctgcccgcaggacacgcatgggccagggtgccaggagcactgtctctgcctgcacggtggcgtctgccaggctaccagcggcctctgtcagtgcgcgccgggttacacgggccctcactgtgctagtctttgtcctcctgacacctacggtgtcaactgttctgcacgctgctcatgtgaaaatgccatcgcctgctcacccatcgacggcgagtgcgtctgcaaggaaggttggcagcgtggtaactgctctgtgccctgcccacccggaacctggggcttcagttgcaatgccagctgccagtgtgcccatgaggcagtctgcagcccccaaactggagcctgtacctgcacccctgggtggcatggggcccactgccagctgccctgtccgaaggggcagtttggagaaggttgtgccagtcgctgtgactgtgaccactctgatggctgtgaccctgttcatggacgctgtcagtgccaggctggctggatgggtgcccgctgccacctgtcctgccctgagggcttatggggagtcaactgtagcaacacctgcacctgcaagaatgggggcacctgtctccctgagaatggcaactgcgtgtgtgcacccggattccggggcccctcctgccagagatcctgtcagcctggccgctatggcaaacgctgtgtgccctgcaagtgcgctaaccactccttctgccacccctcgaacgggacctgctactgcctggctggctggacaggccccgactgctcccagccatgccctccaggacactggggagaaaactgtgcccagacctgccaatgtcaccatggtgggacctgccatccccaggatgggagctgtatctgccccctaggctggactggacaccactgcttagaaggctgccctctggggacatttggtgctaactgctcccagccatgccagtgtggtcctggagaaaagtgccacccagagactggggcctgtgtatgtcccccagggcacagtggtgcaccttgcaggattggaatccaggagccctttactgtgatgccgaccactccagtagcgtataactcgctgggtgcagtgattggcattgcagtgctggggtcccttgtggtagccctggtggcactgttcattggctatcggcactggcaaaaaggcaaggagcaccaccacctggctgtggcttacagcagcgggcgcctggacggctccgagtatgtcatgccagatgtccctccgagctacagtcactactactccaaccccagctaccacaccctgtcgcagtgctccccaaaccccccaccccctaacaaggttccaggcccgctctttgccagcctgcagaaccctgagcggccaggtggggcccaagggcatgataaccacaccaccctgcctgctgactggaagcaccgccgggagccccctccagggcctctggacagggggagcagccgcctggaccgaagctacagctatagctacagcaatggcccaggcccattctacaataaagggctcatctctgaagaggagctcggggccagtgtggcttccctgagcagtgagaacccatatgccaccatccgggacctgcccagcttgccagggggcccccgggagagcagctacatggagatgaaaggccctccctcaggatctccccccaggcagcctcctcagttctgggacagccagaggcggcggcaaccccagccacagagagacagtggcacctacgagcagcccagccccctgatccatgaccgagactctgtgggctcccagccccctctgcctccgggcctaccccccggccactatgactcacccaagaacagccacatccctggacattatgacttgcctccagtacggcatcccccatcacctccacttcgacgccaggaccgttgaggagccaggatggtatggcagaggccagcacacctggctgttgctgctcaaggctggggacagagcctagtgtacccctgccaggagcagggagtggaccggcaggctgtgaacatgaacaacgcttaacagagcaagtgatgggagccttgttcctgggttctaccatgggagacgctgatcagcaggatgcctggctccctttcccaacccactgctcccaaggcctccagggccctgtgtacataaactggtgggttggaagttgctgggtaactctgatttcagacatgcgtgtggggtaccttttctgtgcatgctcagcctgggctctgtgcgtgtgtgtgtttctgtgattttagaagggtaccaggcacaggttctgtcctagggcacttaccatttagtagggagatggaaccaacccaattaactctagcaatagcctcctaactggcctcctccattgattcagtgaaccttccaatgcatggctcataatttcaaaatacaggctggttagttactccctacctgaaagccttcataggtgcctctttgctcttctgccagtatcaaaacttttgaaggccttaaaggccctgctttgcctggcccatctgtctctccagcctcaccttgaactgtgttcctgtcactgcacgccagtcacaccggcctctaggtcctcctgtaggccactcttctttctggcacagggacctgcacacctggagtgcccttcctcccccactcgcctgttcacccctgcttttcctttacacctcctcctcagggaagtgcccaccctccgtacatctttcacagccctgattgcagctgtgttcactcaccaggtacctgcagaaggcctacagggtgccaggcacttctttaatgtgttctttctttatgtgattatttgattaatctctgcctcccccactagactgtaagctccctgaaggcaagaatcctgtgcttatgctcaatattagctctcccttggcacagagtaggcactcaacaaatgctccccaaaaggctgagtggctgactgaattaagtaccagtgacatgcagtaactgctaagatagatgagccatctgtatgctctgacagttacagactgaataagttggagacttccctaaagggtggcatttccccagggtaacaacgcagagctcaggtgtgggaaggtgccaggggcaggggtgcagaggggctgaggctgaggggggtgcagaggctggagaaaggataacaggagagagtatacaggcatgccttgatttattgcacttcacaggtagcagaatttttaaagaaattgaaggttttgggacatatatgtgacagcaataggttaagaaaagcaaagcagagaaattgaagatttgtgtcaacactgctttaagcaaatctgttggcaccatttttccaatagcatgtgcccattttgggtctctacattgcattttggtaattgcttgcaatatttcaagcattttcattgttattatatgtgttatagtgatctgtgatcagtgatctttgatatattattgtaattgtttcggggcgccatgaaccgcacccatataacacggtaaacttaatcagcaaa

SEQ ID NO: 4936 - DNA, 642 bp, Homo sapiens
ggctggggctcgaagtggggaccctcgccccgtcctcggctgtccagtcctcctcctcgcagaccccggcggttcctaccccaggccgcaggggagacggggccccaaggcaggcctctgcaatgtcaccgcctctgtgtcccctccttctcctggctgtgggcctgcggctggctggaactctcaaccccagtgatcccaatacctgcagcttctgggaaagcttcactaccaccaccaaggagtcccactcccgccccttcagcctgctcccctcagagccctgcgagcggccctgggagggcccccatacttgcccccagcccacggttgtataccggaccgtgtaccgtcaggtggtgaagacggaccaccgccagcgcctgcagtgctgccatggcttctatgagagcagggggttctgtgtcccgctctgtgcccaggagtgtgtccatggccgttgtgtggcacccaatcagtgccaatgtgtgccaggctggcggggcgacgactgttccagtgagtgtgccccaggaatgtgggggccacagtgtgacaagccctgcagctgcggcaacaacagctcgtgtgatcccaagagtggggtatgttcttgcccttctggtctgcagcccccgaact

SEQ ID NO: 4937 - DNA, 4513 bp, Homo sapiens
ctcgctcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtctagaggagtcccaggagcagccaggacaggcggaagcagtggctgccatggaggaggacaagctcttatctgcagtgcctgaggaaggcgatgccacccgtgaccccggtccagagcctgaagaggagccaggggtccggaatgggatggccagtgagggcctgaacagcagcctctgcagcccagggcacgagcgaaggggcaccccagcggacactgaggaacccacgaaggacccagatgtggccttccatggcctcagccttggcctctctctcaccaatggcctagccctggggccagacttgaacattctggaagattcagcggagtccaggccctggagggctggcgtgctggcagagggggacaatgcttccaggagcctctacccagatgctgaggaccctcagctggggttggatggtcccggggagccagatgtgcgggatggcttcagcgccacgtttgagaagattctggagtcagagctgctgcggggcacccagtacagcagcctcgactccctagacgggctgagcctcacggatgagagcgacagctgcgtcagcttcgaggcccccctcacacccctcatccagcagcgggcccgtgacagccctgagccaggggctgggttgggcattggggacatggcgtttgagggggacatgggggcagctggtggtgatggggagctgggcagccccctgcggcgctccatctccagcagccgctctgagaatgtcctgagccgcctgtctctcatggccatgcccaatggattccatgaagatggccctcagggcccagggggggatgaggatgatgatgaggaggacacggacaagttgctgaactcagccagtgaccccagcctgaaggatggcctgtcagactcagactctgagctcagcagctcggaggggttggagcctggtagtgcagaccctctggccaacgggtgccagggggtcagtgaagctgctcatcggctggcacgccgtctctaccacctcgagggcttccagcgctgtgatgtggcccggcagctgggcaagaacaacgagtttagcaggctggtggccggggagtacctcagtttcttcgacttctcgggcttgactctggacggagcactcagaacattcttgaaggccttcccgctgatgggggagacacaagagcgtgagcgggtcctcacacacttctcccgccggtactgccagtgcaaccctgatgacagcacttcggaagatgggatccacacgctcacctgtgccctgatgctgctcaacacggacctgcacggccacaacattggcaaaaagatgtcctgtcagcaattcattgccaacttggaccagctgaatgatggccaagactttgccaaagacctgctgaagaccctttacaactccatcaagaatgaaaagctggaatgggccattgatgaggatgagctgaggaaatccctgtctgagctggtggatgacaagttcgggacaggcacgaagaaggtgacgcgaatcctggatggtggcaaccccttcctggatgtcccacaggcgctcagtgccaccacctacaagcacggcgtcctgacccggaagactcacgctgacatggatggcaagaggacgccccgtgggaggcgtggctggaagaaattctacgcagtgctcaaagggaccatcctgtacctgcagaaggatgagtacaggcctgacaaagctctatcggagggtgacctgaagaacgccattcgcgtgcatcacgctctggccaccagggcctctgactacagcaagaagtccaacgtgctgaagcttaagacagccgactggagggtattcctcttccaggcaccgagcaaggaagaaatgctgtcctggatcctcaggatcaacctggtggcagccatcttctctgccccggccttcccagccgctgtcagctccatgaagaagttctgtcggcccctgctgccctcctgcaccacccgcctctgccaggaggagcaactgcggtctcatgagaataagttgaggcagctgactgcggagctggccgaacacaggtgtcacccagtcgagaggggcatcaagtccaaggaggccgaggagtaccggttgaaggagcactatctcaccttcgagaaaagccgttatgagacctatatccacctcctggctatgaaaatcaaagtgggctcagatgatctggagcggattgaggcccggctggccactctggaaggggatgacccttctctccggaagacacattcaagccctgccctcagccagggccatgtgactggcagcaaaaccacaaaggatgccactgggcctgatacttagctgacatggatttgcagaccccagggtgggcagatgtctccagtggggtcagtgagcacaattccagccaggggccacttggaccaagctccagtcagttgatgggcagctagaggggtgcagaaagcctgtgggcccaggagatggagatgccgtttgtggcgttgatctccttgcgtccttgggcatctccgggcatcagaccctctccctggcccttgttttcctctccaccatggagcctcattttgtaggccagttgtgtgcatgctctagacaccacctcgctggagaagctggaagggctgttgtcttcccaggtctttctcttctcatcaagctcctctcctcatcttttttgtgtgtgagggcaggtcttgactctaggtctcagctggaaccccaccctttctcctcctccttcctctgagttgaccagcagcaggtctgccgaccaccagcaccatcctctcctcccagcagcctccagaaccatgcccaggtctcctgcctcacatcacaataatctgggacccaggcttgtgccctttcagtgtaaagctgactccatcacatgtgcatccacttcttttcatccattgagatcacactgcctcctttttatacagacacaaatatacatctataagaataatatatacataaggaacccctgaaagatggttttggaactggaatcagttagaggatgaaatcagataaaggaaaagcctattttggagcttcccctgttaggaaggatggctgcacctggccccctggcattcctgacgctctaggagggaagggggaggcagtgctggcctcccttgccctgtttttccctcttccagctgacctgtgacttatactgctcttaccgatgatacttttggaaaaaatagagcgtgtatgcaccgccccgtttgtcccatggatatcctggggtgtgagtcggatgggaccacggccctgtttatatttgggtctttatgttggtgctgccaggtctctgagctccagaggtggcctcttggacagatctactgctataggaataaaagacactctgtctcgcaaatggctgcttgtcaacaagcccaaagatgcttgtcggaggacggttatggaagcccttaattcttggttgtgggaaaaggtggaatgacaagttattgattgtttttctgtcgctatttctttcatttgtctagtgaatcagaaaggcttagccaaggccacatctgggaagagtggagaaatttgccacttgacgatcacggattagctagcacctttaagccctgcatttctccaactgacaagtgggtgggggtgatggcacattcagtgtggctatgaagagcgaatcctctctattgtttaaatagattactgtagtttggccaggaatttggcgtcagtggtaacacacttagttaataaaataagccaggcttgcaactaagtatctaactttacaggcccactcacatttgaggcaaggggctattgagtatgtggagagatgtagtgatttaaattcagattatttaagttggatcagctgaagtgtgttttagacccaaaccatctggccccttcgttttgctcagaggaagtaaatgttcacttaaatgaaattgaaaacgccatgtggcaccacaaaagagctctctgtactttccccatgctgcctcaaaagttctgtgagtttcggggtcagtgtcccacccttcacttcccgagggcgggtgagtggagagcagagccaggagctctggcagctgtggacagatgtgcttcctgagcatgggttgtgcctcccatcagtaaaaaaatgtttagttcacttccttaattgtataattatttatttgtaaattatatacatgtactactgtactaaaatattatgtacattataaaacatacacaaaaatagaaatttaaaaaagatgagatgaaaataaatctaagtcaaagttctaa

SEQ ID NO: 4938 - DNA, 2870 bp, Homo sapiens
aagcaagttgctgcctgtgaccacagtctgcagaggccagagagagcaggaaaggaaatggaaaggaacctcaccttcatgcttggggaaaaggagaaacctgtgttaatgtgtcttcccaacatcccactctcttcagcaatcgctggaacagccatgggccatccctgctgagtcaggaaagaagctgagggaagagtcgggattgaaaagcagcagacaaggctggcactgatcccagtttatcctttgagattcagcagaagatcctgatggaggaggaggataccaagagagaggtgcccaaggaagatggagttggtgatgtgcaacatttcgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcattttcaaggccct

SEQ ID NO: 4939 - DNA, 5673 bp, Homo sapiens
tgaccacagtctgcagaggccagagagagcaggaaaggaaatggaaaggaacctcaccttcatgcttggggaaaaggagaaacctgtgttaatgtgtcttcccaacatcccactctcttcagcaatcgctggaacagccatgggccatccctgctgagtcaggaaagaagctgagggaagagtcgggattgaaaagcagcagacaaggctggcactgatcccagtttatcctttgagattcagcagaagatcctgatggaggaggaggataccaagagagaggtgcccaaggaagatggagttggtgatgtgcaacatttcgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaa

SEQ ID NO: 4940 - DNA, 5543 bp, Homo sapiens
gagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggagaaggtaaagcttgatgctgaaagggaaaaactagagaggcttcaggagctttactccgagcagaagacccagctggacaattgtcctgagtccatgagggaacagttacaacaacaactgaagagggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatg

SEQ ID NO: 4941 - DNA, 5996 bp, Homo sapiens
gtctggtgaggaaatcatcaccctaggacgtaaaccctcccgcccttctttcagctcttaaaaaaagcctgccacgaaagtccctactgcgttgctgcgaacgtagctttgagaagctggcgcccagtgatggggcaaacagccatgcccttccagcagccgtgaaagccccaacagcaaactgcctgggagcggggcaggtcaccaacttcgttgctcgaactccctgggtgcccgccgcggtggttacaaagggggtcaagagtgccggacccagccgcgcggagcccaccattgcggcccgagggggacccgacgggggcccgacggtgtggcgtggcgcaaggagcgcgcctgccttctctcgccgccgggaacgggctgcaccaatggccagattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagttacctatctgtagtatgatggaggatgaattaatcgcaaatgacagttgtagaaactatgtaaagtttgttgtgtgctaacattatgatttgtagtgtataaactgaagtattccaatagaagtatctctggttacatcctattgcttacaaaatgaaatgaaccctgaaaaactctgacatcatattgttgtctgtttacacagatacatttattgctggggattgc

SEQ ID NO: 4942 - DNA, 6127 bp, Homo sapiens
gtctggtgaggaaatcatcaccctaggacgtaaaccctcccgcccttctttcagctcttaaaaaaagcctgccacgaaagtccctactgcgttgctgcgaacgtagctttgagaagctggcgcccagtgatggggcaaacagccatgcccttccagcagccgtgaaagccccaacagcaaactgcctgggagcggggcaggtcaccaacttcgttgctcgaactccctgggtgcccgccgcggtggttacaaagggggtcaagagtgccggacccagccgcgcggagcccaccattgcggcccgagggggacccgacgggggcccgacggtgtggcgtggcgcaaggagcgcgcctgccttctctcgccgccgggaacgggctgcaccaatggccagattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggagaaggtaaagcttgatgctgaaagggaaaaactagagaggcttcaggagctttactccgagcagaagacccagctggacaattgtcctgagtccatgagggaacagttacaacaacaactgaagagggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagttacctatctgtagtatgatggaggatgaattaatcgcaaatgacagttgtagaaactatgtaaagtttgttgtgtgctaacattatgatttgtagtgtataaactgaagtattccaatagaagtatctctggttacatcctattgcttacaaaatgaaatgaaccctgaaaaactctgacatcatattgttgtctgtttacacagatacatttattgctggggattgcaa

SEQ ID NO: 4943 - DNA, 5474 bp, Homo sapiens
aggtcagactgcaagattgtttgttcagatgtaggcctaacaagggattgttcttttaaaatcttctttaaggcaaaattttctgttttatttctttacagattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagtta

SEQ ID NO: 4944 - DNA, 3646 bp, Homo sapiens
agaagctggcgcccagtgatggggcaaacagccatgcccttccagcagccgtgaaagccccaacagcaaactgcctgggagcggggcaggtcaccaacttcgttgctcgaactccctgggtgcccgccgcggtggttacaaagggggtcaagagtgccggacccagccgcgcggagcccaccattgcggcccgagggggacccgacgggggcccgacggtgtggcgtggcgcaaggagcgcgcctgccttctctcgccgccgggaacgggctgcaccaatggccagattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaa

SEQ ID NO: 4945 - DNA, 6752 bp, Homo sapiens
agtgtgtgggcggcggcggcggcggctgcgcgcttggggcccggggcgcggggcgaggccgtggggacgtgcgagcggggccgcggtggggctcgggggcgcgtccacgtggccagagggcggccacccggagccagcggagggacaggcctgtccccaggcgcggctgccggccatgccctctgtctgcctcctcctgctgctcttccttgccgtggggggggccctgggcaacaggcccttccgtgccttcgtggtgacagacaccacgcttacccacctggctgtgcaccgggtgactggggaggtgttcgtgggcgcagtgaaccgagtctttaagctggcccccaacctgactgagctgcgggcccatgtcacggggcccgtcgaggacaacgctcgctgctacccgccccccagcatgcgcgtgtgtgcccaccgcctggcccccgtggacaacatcaacaagctgctgctcatagactatgcggcccgccgcctggtggcctgcggcagcatctggcagggcatctgccagttcctgcgtctggacgacctcttcaagctgggtgagccgcaccaccgcaaggagcactacctgtcgggggcccaggagcccgactccatggctggtgtcattgtggagcagggccaggggcccagcaagctgtttgtgggcactgctgtcgacggcaagtcggagtacttccccaccttgagctcccgcaagctcatcagtgatgaagacagcgcggacatgttcagtctcgtgtaccaggatgagtttgtgtcctcccagatcaagatcccctcagacacgctgtccttgtaccctgcctttgacatctactacatctacggcttcgtcagcgcctccttcgtgtacttcctgacgctgcagctggacacccagcagacgctgttggacacagcgggcgagaaatttttcacgtccaagatcgtgcgcatgtgcgcgggagactcagagttctactcatacgtggaattccccatcggctgctcctggcgcggcgtggagtaccgcttggtgcagagcgcccacctggccaagcctggcctgctgctggcccaggccctgggcgtgccggctgatgaggacgtcctcttcaccatcttctctcagggccagaagaaccgggccagcccaccccggcagaccatcctctgcctcttcaccctcagcaacatcaatgcccacatccggcgccgcatccagtcctgctatcgtggggagggcactctggctctgccctggctgctgaacaaggagctgccctgcatcaacacccccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtgcgggtcgatggcttccaggatgcccacctgtatgagacagtccccgtggtggatggcagccccatcctccgagacctgctcttcagcccggaccaccggcacatctatctcctgagtgagaagcaggtgagccagctcccggtggagacctgtgagcagtaccagagctgcgcagcctgcctgggctccggggacccgcactgtggttggtgtgtgctgcgacacaggtgctgccgcgaaggggcctgtctgggcgcctctgccccacacggctttgctgaggagctgagcaagtgtgtccaggtgcgggtccggcccaacaatgtgtcagtgacgtcacctggggtgcagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggggccacccgcactgtgcggctgcagcttctctccaaggagacaggcgtgaggtttgccggtgctgactttgtcttctacaactgcagcgtcctccagtcgtgcatgtcctgtgttggcagcccttacccctgccactggtgtaagtaccgccacacgtgtaccagccgcccccacgagtgctccttccaggagggcagggtccacagccctgagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcgtactcctatgaaggtgatgagcatggtgacaccgagctggacttctccgtggtctgggatggagacttccccatagacaagcctcccagcttccgagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcagatccaccctctcgtggggcccaaggaaggaggcacccgggtcaccatcgtgggtgacaacctgggcctcttgtcccgagaggtgggcctgcgggtggctggcgtgcgttgcaactccattccggccgagtacatcagtgctgagaggatcgtgtgtgagatggaggagtcgctggtgcccagcccgccgccggggcccgtggagctgtgtgtgggtgactgttcagccgacttccgcacgcagtcggagcaggtctacagctttgtgaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaatggaagcactgccatcactgtgagtgggacccacctgctgacggtccaggagccccgggtccgtgccaagtaccgcggcattgagaccaccaatacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgccatcca

SEQ ID NO: 4946 - DNA, 7346 bp, Homo sapiens
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtgcacttttcaaggagattgtgtacattcagagaacttagaaaactggctggatatttcgtctggagcaaaaaagtgccctaaaattcagataattcgaagcagtaaagaaaagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaagatgtttcagttgtcaacgtgatgttctccttcggttcttggaatttatcagacagattcaactttaccaactgctcatcattaaaagaatgcccagcatgcgtagaaactggctgcgcgtggtgtaaaagtgcaagaaggtgtatccaccccttcacagcttgcgacccttctgattatgagagaaaccaggaacagtgtccagtggctgtcgagaagacatcaggaggaggaagacccaaggagaacaaggggaacagaaccaaccaggctttacaggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcagtggtggtcaaaatataaccatgatgggcagaaattttgatgtaattgacaacttaatcatttcacatgaattaaaaggaaacataaatgtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaaaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtcaagctgggaaacctggagctctacgtcgagcaggagtcagttccttccacatggtattttctgattgtgctccctgtcttgctagtgattgtcatttttgcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacattttatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtg

SEQ ID NO: 4947 - DNA, 2455 bp, Homo sapiens
acttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgca

SEQ ID NO: 4948 - DNA, 1923 bp, Homo sapiens
cgccgcgccgctgcggctgcaggcggcgacggctacaccatgggccggctgctgcgggccgcccggctgccgccgctgctttcgccgctgctgcttctgctggttgggggagcgttcctgggtgcctgtgtggctgggtctgatgagcctggcccagagggcctcacctccacctccctgctagacctcctgctgcccactggcttggagccactggactcagaggagcctagtgagaccatgggcctgggagctgggctgggagcccctggctcaggcttccccagcgaagagaatgaagagtctcggattctgcagccaccacagtacttctgggaagaggaggaagagctgaatgactcaagtctggacctgggacccactgcagattatgtttttcctgacttaactgagaaggcaggttccattgaagacaccagccaggctcaagagctgccaaacctcccctctcccttgcccaagatgaatctggttgagcctccctggcatatgcctcccagagaggaggaagaagaggaagaggaagaggaggagagggagaaggaagaggtagagaaacaagaggaggaggaagaggaggagctgctccctgtgaatggatcccaagaagaagccaagcctcaggtccgtgacttttctctcaccagcagcagccagaccccaggggccaccaaaagcaggcatgaagactccggggaccaggcctcatcaggtgtggaggtggagagcagcatggggcccagcttgctgctgccttcagtcaccccaactacagtgactccgggggaccaggactccaccagccaagaggcagaggccacagtgctgccagctgcagggcttggggtagagttcgaggctcctcaggaagcaagcgaggaagccactgcaggagcagctggtttgtctggccagcacgaggaggtgccggccttgccttcattccctcaaaccacagctcccagtggggccgagcacccagatgaagatccccttggctctagaacctcagcctcttccccaccacagctcctggccctggtggaagaggtgctgccccgccatggcagtggccaccatggggcctggcacatctctctgagcaagcccagcgagaaggagcagcaccttctcatgacactggtgggcgagcagggggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcggcgcttcctgcgccccgggactcaatta

SEQ ID NO: 4949 - DNA, 2186 bp, Homo sapiens
cgccgcgccgctgcggctgcaggcggcgacggctacaccatgggccggctgctgcgggccgcccggctgccgccgctgctttcgccgctgctgcttctgctggttgggggagcgttcctgggtgcctgtgtggctgggtctgatgagcctggcccagagggcctcacctccacctccctgctagacctcctgctgcccactggcttggagccactggactcagaggagcctagtgagaccatgggcctgggagctgggctgggagcccctggctcaggcttccccagcgaagagaatgaagagtctcggattctgcagccaccacagtacttctgggaagaggaggaagagctgaatgactcaagtctggacctgggacccactgcagattatgtttttcctgacttaactgagaaggcaggttccattgaagacaccagccaggctcaagagctgccaaacctcccctctcccttgcccaagatgaatctggttgagcctccctggcatatgcctcccagagaggaggaagaagaggaagaggaagaggaggagagggagaaggaagaggtagagaaacaagaggaggaggaagaggaggagctgctccctgtgaatggatcccaagaagaagccaagcctcaggtccgtgacttttctctcaccagcagcagccagaccccaggggccaccaaaagcaggcatgaagactccggggaccaggcctcatcaggtgtggaggtggagagcagcatggggcccagcttgctgctgccttcagtcaccccaactacagtgactccgggggaccaggactccaccagccaagaggcagaggccacagtgctgccagctgcagggcttggggtagagttcgaggctcctcaggaagcaagcgaggaagccactgcaggagcagctggtttgtctggccagcacgaggaggtgccggccttgccttcattccctcaaaccacagctcccagtggggccgagcacccagatgaagatccccttggctctagaacctcagcctcttccccactggcccctggagacatggaactgacaccttcctctgctaccttgggacaagaagatctcaaccagcagctcctagaagggcaggcagctgaagctcaatccaggataccctgggattctacgcaggtgatctgcaaggactggagcaatctggctgggaaaaactacatcattctgaacatgacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcggcgcttcctgcgccccgggactcaattaaacccgcccggagaccacgccgggcccagcgcgtctgc

SEQ ID NO: 4950 - DNA, 3104 bp, Homo sapiens
acttctcacttctgcccataacaagaaaaacatagacttgtgccttactcttaaaaaaataataataataaatataggttttttaaaatttatatataatttttaaaaccccgtttgttgcatgtggtccctttccctcctgttgttgagcagaataaaagcccattttgccagggcccgcagtcctggcggcccccgcagctgcggccctgtaactttaaacctggcctgagatcatcgttttggcgccggccaaacagagcccgagggcgggcctagcgcgcccggacggagaccaccttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggatttttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccattttttgcaatgatgtctggatgttattttaaacagtgtgtctgtgtgttcccaaatccagctggccccaccagctcagattccattttttttgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaa

SEQ ID NO: 4951 - DNA, 2801 bp, Homo sapiens
accttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggatttttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccattttttgcaatgatgtctggatgttattttaaacagtgtgtctgtgtgttcccaaatccagctggccccaccagctcagattccattttttttgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaa

SEQ ID NO: 4952 - DNA, 1368 bp, Homo sapiens
ttagtcggtgccaggtcccaaagacgcagctgcgcgggtgtgccgggaggagccccggaatccacaggctgcgagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctg

SEQ ID NO: 4953 - DNA, 849 bp, Homo sapiens
gacaatgtgcaaatgacaccgttttgtgctcaccagggcaaagcaagggagcgccctcacttcagcatctcagccctgctaaagaaaaagctgctggccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaacc

SEQ ID NO: 4954 - DNA, 607 bp, Homo sapiens
ctttttggcgagacaatgtgcaaatgacaccgttttgtgctcaccagggcaaagcaagggagcgccctcacttcagcatctcagccctgctaaagaaaaagctgctgggtaacatcctttgtttttgcccagggaagctttagctgtgattcccttcagccggctcctgaatgtcaaagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagct

SEQ ID NO: 4955 - DNA, 1305 bp, Homo sapiens
gtcggtgccaggtcccaaagacgcagctgcgcgggtgtgccgggaggagccccggaatccacaggctgcgaggggaaggcgtttaacaactcgggggtgaagcctggtggacagcggcagggacatcataaatacagaagataattttaaagaagtgttccggccgggtgcagtggctcacaactgtaatcccaggactttgggaggctgaggcgggcagatcacctgagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcact

SEQ ID NO: 4956 - DNA, 1583 bp, Homo sapiens
tctgcactgctagggcagaggactgctgtttgctgacacaatcttggtgcgttggaagtgaaagggaagaggcactggtggctgtgctttgggcccgagcagccagaagccagttgccatcacctatgacgaggagacagcgcctggggcagagcccagtatggggcctagccagggctgggttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacctggactggagggggccatggggcaccggaccctggtcctgccctgggtgctgctgaccttgtgtgtcactgcggggaccccggaggtgtgggttcaagttcggatggaggccaccgagctctcgtccttcaccatccgttgtgggttcctggggtctggctccatctccctggtgactgtgagctgggggggccccaacggtgctggggggaccacgctggctgtgttgcacccagaacgtggcatccggcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgccccgccgactcctgcccccattctgcgggcagacctggccgggatcttgggggtctcaggagtcctcctctttggctgtgtctacctccttcatctgctgcgccgacataagcaccgccctgcccctaggctccagccgtcccgcaccagcccccaggcaccgagagcacgagcatgggcaccaagccaggcctcccaggctgctcttcacgtcccttatgccactatcaacaccagctgccgcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagaggcctcctcacactggtcccggcctcactcttttccctgaccctcgggggcccagggccatggaaggacccttaggagttcgatgagagagaccatgaggccactgggctttccccctcccaggcctcctgggtgtcacccccttactttaattcttgggcctccaataagtgtcccataggtgtctggccaggcccacctgctgcggatgtggtctctgtgtgtgcgtgtgtgggcacaggtgtgagtgtgtgagtgacagttaccccatttcagtcatttcctgctgcaactaagtcagcaacacagtttctctgatgtcggc

SEQ ID NO: 4957 - DNA, 2731 bp, Homo sapiens
gcggcgcagcagcctcgcccgtcgcggagagtgggctctgcccgccgtcccccgggggctgcttcccgccccaggcctccgcggaggacacgtgtcagcacgttcccgcggttgtcattccattgtcatagcccttcccctaggccgggaacccctcccccccaccagccccagttcctttatccctgggcccaacctccccgccgacccgcggtccaggcctcggtctctctcttcggcggcgagccgcggcccagaccccggcagaggacacttgtcggcacgttctcacccctgtcatctcagccccctgcctagctccaccccaggcttgggaacccggcccctgacggcccattgtccgcgggcccagcccccgcgctgaacgcacgctcgcccttgcccctaaccagcgcgtctaccccggcaacgcgcagtgacctgggatgcagccctcaggctgggcggccgccagggaggcggcgggccgcgacatgctggccgccgacctccggtgcagcctcttcgcctcggccctgcagagctacaagcgcgactcggtgctgcggcccttccccgcgtcctacgcccgcggcgactgtaaggactttgaagccctgcttgcagatgccagcaagttacctaacctgaaagaacttctccagtcctccggagacaaccacaaacgggcctgggacctggtgagctggattttatcctcaaaggtcctgacaatccacagtgcagggaaggcagagtttgaaaagatccaaaagctgactggggctcctcacacgcctgttcctgcaccggacttcctgtttgaaattgagtactttgacccagccaacgccaaattttatgagaccaaaggagaacgagacctaatctatgcatttcatggtagccgcctagaaaacttccattccattatccacaatggcctgcactgccatctgaacaagacatccttgttcggagaggggacctacctcaccagtgacttgagcctggccctcatatacagcccccatggccatgggtggcagcacagcctcctcggccccatccttagctgtgtggccgtgtgtgaggtcattgaccatccggacgtcaagtgccaaaccaagaagaaggattccaaggagatagatcgcagacgagcgagaatcaaacatagtgaagggggagacatccctcccaagtacttcgtggtcaccaataaccagctgctgcgagtgaagtacctcctggtgtattcacagaagccacccaagagcagggcttcgagccagctctcctggttttccagccattggtttaccgtcatgatatccctgtatctgctgctgctgctcatagtgagtgtcatcaactcctctgctttccaacacttttggaatcgtgcgaaaagataatctttctgggcctggtgtgggggctacctcaactatgtgccttatggtaacttgttctgtacctcctatgcctcatgtccagccaggttgagcctaggggccagttgggggaccacaggacaattttcatatggcctaaatgtatccattgcctttgatgatgttcccagccatactccagtcaacggggactactagtccctcactcttaggttttaggggagtccttccatctgctccttcttaaactgtcctagggagttggcttttcagccagggccaaaggaaaaagccctgctgcatttaaaaacaaagtgtccaagctgtcagtggtgtgtttacaatctctcctggcagaggttggccctttctctaatgccttctggaaggcggaaaatgtgggaactataaatcactaggcggttgccttgttttgacttgagacacccaagaggaacagtcatgtttctcataaaaatcagtgggatcatttttgaattccatcagcctttgtatgtgagtgcaaaacattttaacagttttctcaaatcaacaaacagccttctcctatagctgtacttgcccccctccccaaaaaaccatggatgagaaagaaaggagtcaggggcctgataaaaaatacagacttaatgagcaactcaagatgagaaaactgctctttttccaaaaattaccaactgctgattacagctgaaatggaaccaaatgtttgttttctgatttttttttaatagctgtttaacaaattagtctttgctgagtaaaaggggaaatttctaaacctagtgcactgtttggccagtgtccacagcctcttttctggctgtgttttagagaaagggatttgagctataggctcgcctcctgttctcattctcacaaagctgccttgactgtggcctgcaaccacgagtgccatgctttcaggtcttctgtggcctactggccttcaagacagaggcctgccccagtgtgccacagatccatgtggatggagcctccttcagaggggtcacaggtctttgagactcagcctgggctttaatgtgtaggaaaagccttctggccacccagagagccggagccctgcttgctgtattctctgctcccttcttcctgctgggttttagccataatagggcccggtacgatttgggagtgacatttctgtaaagaagaggaaaaatcatttttctataatttgtaaagttgtgaaagagccactaccacagtttttacattgattattggaacatttcagaataaataaagatattttcttaatgatttaa

SEQ ID NO: 4958 - DNA, 1921 bp, Homo sapiens
acgtgatagcgctgggcgactccgcggagctgcacggccatggacgtgggcgccgacgagttcgaggagagcctccctctgctgcaggagctcgtccaggaggccgacttcgtggaggtgagcgcgggtgccttggccgcctgcagatctacagtgtgaggagtgctggcgatgttctgcacccgaggactgctattttttgccttcctggcaggtctggacatagagttcacgggccttcgttctaacctgtctgggccccagcagatcagtctttttgatttgccatcggagtggtatctaaagacccgtcagagtgttcagcaatttacagtctgtcagattggattgtctgtgttttccgctattgaaggagaggcaaacaagtatatagcccattcttgtaacttctatctcttccctacaacgtttgggattttggactcagaattctccttccaggcttccagtgttcagtttttgaatcagtatggcttcaactataacaagtttctcaaaaacggaatcccatatatgaatgaagaacaggagaagaaaattagacacgatatcctgactgggaactggagagttcgcagctctccggataaagaccaaatcaaggtggtgattgacgaagtgacgcggtggctggagctggccaaggaaggcgactggatgactcttcctgggatcactggcttccaggcctttgaggtccaactggtgctgaggcaggccctccccaacatctggacggtgctgaaagatgagggggtggtagtgaagaaagtgagtaaacaacatcgttggtatcttcagaacacctcttgtgaccgagagagctgttggaaggaaaatattcttctctcagcaaggggtttttctgtctttttccaaatgctggtgaaagcccagaagcccttagtgggacataatatgatgatggacctgctgcacctccatgagaagttcttcagacccctcccagaaagctacgatcaatttaagcagaatatccacagcctatttcctgttctcattgataccaagagtgtaacaaaggatatctggaaggagatgaatttcccgagggtgtcgaatctttcggaagtctatgaagtcctgaacagtgacttgaatcccaccaagaattctggaccagagattgttcacgcgagcaggtgtgagaaatatgttgagacaaagtgcccccacgaagccgcgtatgatgccttcctctgtgggtcagttcttttgaaagtggcacacttgcttctacagaagatataccacatcgaccccgtgcccgagtcatcctttcctcagtaccttgacgtgctggctccttacgtgaaccaagtgaacctcatccgagcgggggtcccaaagatcaatttttctggtccagattatcccagtatccgacctcccatcctcatcctcagcgtcaaaaggtggcctggggtcagcgagcagcaagtctaccataagtttcagaatctctgcaagtttgatgtcaggcgactcacaagaagccagttcttactcctgaccaataagtttaaggatgcgcggaacatcctgaaggagtaccgggaccacccgaccctgtgcatctccctgtaccgctactggaggcactccccaaacgtcaactgcctgctccaagtctgtggcatagtgactgcctgggcccttctcgcgttcatccttggaagatctggtacctgagtgcagcgaggcctcctgcggccaccctcgggtccccatgctctctgggaggtgtgctgggtgtgttcgtgtaaatcagattctgtttgcagatggatctgtttggtcttttctagaaattctgttatgtcctgaacgtgaaattctgtcaacactctcaatgataaatcagtccttagatatcgta

SEQ ID NO: 4959 - DNA, 1290 bp, Homo sapiens
atggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacctc

SEQ ID NO: 4960 - DNA, 3308 bp, Homo sapiens
atggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgatttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaatgagattctaactaggatgaatgtggtagtaatgatgtatatttttcaaatttacctaaacagaaagattattggctaaggcatggtggctcacacctgtaatcccaacactttgggaggtcaaggcgggtagatcacctgaggtcaggagttcgagaccagcctggccaacatggtgaaaccccatctctactaaaaatacaaaaattagctgggtgtggtggcgggcgcctgtaatcccagctactcaggaggctgaggcaggagaatctcttgaacctgggaggcagaggtggcagtgagctgagatcgcaccactgcactccagcctgggcaaaaagagtaaaactccatctcaaaa

SEQ ID NO: 4961 - DNA, 4411 bp, Homo sapiens
ggaaacgaaactccatcaggctccgccccacggtctgcggagtgagccaatcagggcacagcctgcgttgaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgatttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaatgagattctaactaggatgaatgtggtagtaatgatgtatatttttcaaatttacctaaacagaaagattattggctaaggcaggcggatcatgagatcaggagatcgagaccatcctggctaacacggtgaaaccccgtctctactaaaagtgcaaaaattagccgggcgtggtggcgcatgcctgtaatcctagctactcaggaggctgaggcagaagaatcacttcaacccaggaggtggaggttgtagtgagccgagattgcgccattgcactccagctcaggcaacaagagcaaaactccgtctcaaaaaaaaaaaaaaaattgtttacttatcaaattgaactaggtcaatttgaatatgtgtattgctctaatgtatggaagttcttagtataagagctgaaggatcatgactttcggttaatagatgtttgaaatagatgtttagaggttactgatacacatgtcaagttgttcattcccatcatttaaaatatcaccttataattccacagaaaagtaaatggtatgtggacgtcataatttagaatgtgtaatcttttttaaaatcttataaaaatacactggactcagtggtacgtgcctgtagtcccagctacttggaaggctgaagtgggaaggtcactagagcccagaagttcgacactgtagtgtgcaacaatcatacctgtgaatagctactgtactccagcctgggcaacatagcaggactcttatctctaaaaaaaattttaaatcttataaaaatgtaggtatatctggccaggcatggtggctcacacctgtaatcccaacactttgggaggtcaaggcgggtagatcacctgaggtcaggagttcgagaccagcctggccaacatggtgaaaccccatctctactaaaaatacaaaaattagctgggtgtggtggcgggcgcctgtaatcccagctactcaggaggctgaggcaggagaatctcttgaacctgggaggcagaggtggcagtgagctgagatcgcaccactgcactccagcctgggcaaaaagagtaaaactccatctcaaaaaaaaaaatggtgggcacagaagctcatgcctgtaattccagcactttgggaggccgaggcgggtggattacatgaggtcaggaattcaagaccagcctggccaacacggtaaaaccccatctctactaaaaatacaaaaattagctgggcatggtggcaggcacctgtaatcctagctactcgggaggctgaggcaggagaatcacttgagcctgggaaatggaggttgcagtgagccgagattgcgccattgcactccagcctgggcgacagagcaagactccgtctccagaaaaaaaaaaaa

SEQ ID NO: 4962 - DNA, 5997 bp, Homo sapiens
cgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccaggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacgggaggggacttcgcgagcagacgcgcgcgccagcgacagcagcccgccccggcctctcgggagccgtggggcagaggctgcagagccccaggagggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgta

SEQ ID NO: 4963 - DNA, 5320 bp, Homo sapiens
gagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgta

SEQ ID NO: 4964 - DNA, 7011 bp, Homo sapiens
cgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccaggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacgggaggggacttcgcgagcagacgcgcgcgccagcgacagcagcccgccccggcctctcgggagccgtggggcagaggctgcagagccccaggagggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagcccttcacatcctcagccgaagatctcacttcctcccagaggcctttgctgactgacccctcagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtgagcccggagcctctgctatgtgcaaggcggtgtgcaagcaccggctgcagctttttgctctcttctttctctttggggctgggctgggtgtgcgttctggtgctgatgctttggcctgtgaggctgagctagagaaatgtagatgttagatgtgccagtaccatcctgcgcctcccaagcatgcccccactcactcacgtcggcatctcgacccgttcaattacagcaacgaagaagccaccgctaagcgtggtcttgggggaagcccggaggcagtgctcggcacccgggaacgtgctcaggcctcggtggggccgggcaggcagggcgggagctagcctgcaagagaaacagccccaatgctgggtaagagagcagttcaccccatccccccctccacgaccctggcgcacgccctgtacctgaaggcgcccgggttctgctgcagcgcatcttgtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggctcctccagctgtctgctcggcatacctaaggaaaagcgtgtctcggttacacagcttcacaggctgcctcagtcctgaaatcctcgctcctgaaatcctcgcttcacagaggagaacttttgctccagggtcccaagcccattaaagtgtcagaactaagaccaaaacagatgactccaggtctaagctgctgtggacctctgagtccctcagccacgccttctcaccatctcacccgagccactgcaggaaggatccagcaggacatagtggacctcacgatagcgcggatctaagggggagaccgccaggaagtcctcctcagccagctcacagcaggagacgccagcccaggccagcagcgtggccatggatgccagccgcctggcatccaggtcaaaggcaaagatcttcctagggcagagggcagagcaggggtgagctgagcatgcatggagcagctaagggcctgtcacagctgacacagacaaccagaacatgcaggttaagccaggacacacaatattgaaacagcctatatttaaagggcccagggtcagaggtaactggcctggggtctctgccccaagggctaagggatccacatctcacacctgcagtggggaaagcttagcttggggcaaataccgtgaactactttggtgcagcaggaaagagttaagcgaaagtcatcctttcagccttcattacccactgaaaggcacaaaatcaaaccccatgtcctcctcctcctcctgtggcactcacccttggttcttcagaagagcagccaagtgactggtctttattgcctggggtggcacaggcatccatgacatgggagcctggcgggggtccagcagcatggctgggagacagctggcctggcaggcagaacacaggggccgggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagggagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 4965 - DNA, 3750 bp, Homo sapiens
atgtctccggcggctgcggcggctggagcaggcgagcggcggcggcccatagcgagtgtcagggacggccggggccggggctgcggcgggccggccagggcggtgctcctgggcctgtcgctggttggcctcttactgtacctcgtgccggctgcggctgcactggcctggctgaccgtgggggctaccgcggcctggtggggactgagccgcgagccccgaggttcgcgccccttgtcctccttcgttcggaaggcgcgtcatcggcgccccttgtcctccttcgttcggaaggcgcgtcatcggcgaacactgttcgcttcgcctctggccaagtcgacagccaacggaaacctcctagagccgcggaccctgctcgaaggacctgaccctgcggaactgctactcatgggcagttacctgggcaagcccgggccgccgcagcccgccgccgctccggagggccaggacctgcgggataggcctggccgccgcccacctgcccgcccggcgccgcgctccccaccgccgcgctccccaccgccgcgctcccccccgccctccccgccgacccatcgcgctcaccacgtttacccctctctgcccactcctcttctccgaccctccaggaggccttccccacgggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtag

SEQ ID NO: 4966 - DNA, 3977 bp, Homo sapiens
cgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccaggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacgggaggggacttcgcgagcagacgcgcgcgccagcgacagcagcccgccccggcctctcgggagccgtggggcagaggctgcagagccccaggagggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtga

SEQ ID NO: 4967 - DNA, 5700 bp, Homo sapiens
atgtctccggcggctgcggcggctggagcaggcgagcggcggcggccgatagcgagtgtcagggacggccggggccggggctgcggcgggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccacccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgataccagagcagataatcagctcaacactgtcgtcaccatcaagtaatgccccagacccatgtgcaaaggagactgtactgagtgccctcaaagagaagaagaagaaaaggacagtggaggaagaagaccaaatattccttgatggccaggaaaataaaagaaggcgccatgatagcagtggcagtggacattcagcatttgagcccctggtggccagtggagtccccgcttcttttgtgcctaagcctgggtctctgaagagaggcctcaattctcagagctcagatgaccacttgaataagagatcccgaagctcttccatgagctccttgacaggcgcttacacaagtggcatccctagctccagccgcaatgccattaccagttcctacagctccactcgaggcatctcacagctctggaagagaaatggccccagttcatcacccttctctagcccagcctcatcccgctcccagacaccggagaggccagcaaagaaaataagagaagaagagctgtgtcatcattccagttcttcaactccattggcagcagacaaggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagtgatgctgcctcgaactctgtcactgagaccccacctaccactcagccttcatttacctttaccctgcctgctgctgcaactgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaagcagagacggctaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggccccggctactgcacccacacctgcacctgcgtccacgatcaagatcgtgcctgcgcacgtgcctacgcccatccagcctacctttggcggtgccacgcactcggcgtttggattgaaagccacggcttccgccttcggcgctcccgccagctcacagcccgcctttggcggctccactgctgtcttctccttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaacgtggccaccccaggctccagcgccaccaccggagctttcagctttggagcaggacagagtgggagcacagccacctccacccccttcacagggggcttaggtcagaacgccctgggcaccaccggccagagcacaccgtttgccttcaacgtgggcagcacaactgagagcaaacctgtgtttggaggcaccgccacccccacctttggtcagaacacccctgcgcctggagtgggcacatcgggcagcagcctctcctttggggcatcttcagcacccgcccaaggctttgttggtgttggaccgttcggatcggcggccccttcattttccattggtgcgggatccaagaccccaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttccactggggaggctggagaactaaggacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggttatccctaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgcggtttctgtcccacttaactgacctcactggaggctacgtcacccaaagtagatgttagaaaacctaaattaatgaaccatatttttaaaatcctatttttcccaaacagggccctctgcagcccatcctttccttccgtccttctgaaaccacataccccaggcccaagcgccttgctgtcacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatctat

SEQ ID NO: 4968 - DNA, 715 bp, Homo sapiens
cttatgcaggtgatttctgcctttgcaggccggagccctcatgacttcagtgacctgcttctgcccctctaggtctatcagccacagtctctgcatgtttccaagagcagcagaaaatgaacacattgcaggggccagtgtcattcaaagatgtggctgtggatttcacccaggaggagtggcggcaactggaccctgatgagaagataacatacggggatgtgatgttggagaactacagccatctagtttccttggcttatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctgggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgataccagagcagataatcagctcaacactgtcgtcaccatcaagtaatgccccagacccatgtg

SEQ ID NO: 4969 - DNA, 5839 bp, Homo sapiens
gtcatcgcttgctctcgttcccaggctttggcttctagtggacgagaatcaccgagtctgcggggctggatgctgaccgcccggaccagcacctaggcgggcgggagctgtgcggcccagggttcgcgcgggccgggtagaggctcgagctgggacccccgagcgtgaaccccggagccggcggcgctggggccagaggggccgggagccccagggaggcggatctgggccccgagaaggacacccgcctggatttgccccgtaggcccggcccgggcccctcgggagcagaacagccttggtgaggtggacaggaggggacctcgcgagcagacgcgcgcgccagcgacagcagcccgccccggcctctcgggagccgtggggcagaggctgcggagccccaggagggggccagtgtcattcaaagatgtggctgtggatttcacccaggaggagtggcggcaactggaccctgatgagaagataacatacggggatgtgatgttggagaactacagccatctagtttccttggcttatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctgggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgataccagagcagataatcagctcaacactgtcgtcaccatcaagtaatgccccagacccatgtgcaaaggagactgtactgagtgccctcaaagagaagaagaagaaaaggacagtggaggaagaagaccaaatattccttgatggccaggaaaataaaagaaggcgccatgatagcagtggcagtggacattcagcatttgagcccctggtggccagtggagtccccgcttcttttgtgcctaagcctgggtctctgaagagaggcctcaattctcagagctcagatgaccacttgaataagagatcccgaagctcttccatgagctccttgacaggcgcttacacaagtggcatccctagctccagccgcaatgccattaccagttcctacagctccactcgaggcatctcacagctctggaagagaaatggccccagttcatcacccttctctagcccagcctcatcccgctcccagacaccggagaggccagcaaagaaaataagagaagaagagctgtgtcatcattccagttcttcaactccattggcagcagacaaggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagtgatgctgcctcgaactctgtcactgagaccccacctaccactcagccttcatttacctttaccctgcctgctgctgcaactgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaagcagagacggctaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggccccggctactgcacccacacctgcacctgcgtccacgatcaagatcgtgcctgcgcacgtgcctacgcccatccagcctacctttggcggtgccacgcactcggcgtttggattgaaagccacggcttccgccttcggcgctcccgccagctcacagcccgcctttggcggctccactgctgtcttctccttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaacgtggccaccccaggctccagcgccaccaccggagctttcagctttggagcaggacagagtgggagcacagccacctccacccccttcacagggggcttaggtcagaacgccctgggcaccaccggccagagcacaccgtttgccttcaacgtgggcagcacaactgagagcaaacctgtgtttggaggcaccgccacccccacctttggtcagaacacccctgcgcctggagtgggcacatcgggcagcagcctctcctttggggcatcttcagcacccgcccaaggctttgttggtgttggaccgttcggatcggcggccccttcattttccattggtgcgggatccaagaccccaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttccactggggaggctggagaactaaggacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggttatccctaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgcggtttctgtcccacttaactgacctcactggaggctacgtcacccaaagtagatgttagaaaacctaaattaatgaaccatatttttaaaatcctatttttcccaaacagggccctctgcagcccatcctttccttccgtccttctgaaaccacataccccaggcccaagcgccttgctgtcacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatctat

SEQ ID NO: 4970 - DNA, 2062 bp, Homo sapiens
aggggtcggggtctccagaagcggggaggagccagcggaggatctgggcgcagtttcctctctaagttccgccccgagagcgccggccccgcccccgccgttcgcgctctgaccagcccgcagagccagcccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgcta

SEQ ID NO: 4971 - DNA, 1843 bp, Homo sapiens
agggcctctcgaagtgggcttgtgaatggctagattgggaagcaccggcggggtgtcgggaagggtggtgacgcaacatagagactccgcccccttccttggagcgccgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaa

SEQ ID NO: 4972 - DNA, 1953 bp, Homo sapiens
actccgcccccttccttggagcgccgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggcc

SEQ ID NO: 4973 - DNA, 1595 bp, Homo sapiens
actccgcccccttccttggagcgccgcgactcgggctgagggagctcgggccaatcagagggacggccccagaatggcatggtagatggaacgcagctgagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggcc

SEQ ID NO: 4974 - DNA, 931 bp, Homo sapiens
cgcagagccagcccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccaca

SEQ ID NO: 4975 - DNA, 1259 bp, Homo sapiens
cgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagagg

SEQ ID NO: 4976 - DNA, 2843 bp, Homo sapiens
aggctctggggcactccctctgttcctagttgaacttgggtaaggaacaggaatgtggtcagacagggtcagtgggagggctttggccattctgagccaacggtcctttgttagttggcctgaaagaagccatgacttagaacctgaagctgtcaggtggcaagaggccttagtcctggtgtttgatcctggcatagttctgggcctcagtctccccttctgtgaaatgggaataataacctttctacctctgacccttctcctgagtggctatgagggttgtgagagtgaggtgggccaccagagctccctgtccaagccaccgggagcctctcttctgtaggctcttcaagaggtggacctagagtatcactgtgccagggggattcctaagctctgaccctgcctgtctctgctgctcctgccccatctccctctgatccttctcctctgcactgtcttccttttccccttatgccttttctaccctttctgctctggcttttccttatactctgaggagccatctctggaaaaggccccactttcccagacccaggtgtcctaccaggccccaagttgtatccctcgtgctgcttaggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgagtgccagctccccagcccctgggtcagggccaggtcaggaggtggcagttagggtagaattagatagtggagaggaagtggaggatcagagagagggaaagggacaaggggatgggggaagggtaggtaagtcagagtcagagataattcatggggggagactcagagagaatagaatcacagtcctccctgagttggaagatgatgatagaaatgcaagggagatgacgggcgcagtggctcatacctgtaatctcagcacctcgggagggcgaagccagtggatcactcgagttcagttcgagaccagcctgggcaacatggtgaaaccccgtctgtacaaaaaatgcaaaaaaattagctgggtgccctggcatgcccctgtagtcccagctacttgggaggctaaggcaggagaattgcttgaggctgggaggtggacatttcagtgagctgagttcacaccattatactccagcctgggtgacaggagtaaaaccctgtctcaaaaacaaaacaaaataaaaaaaaaaaaacagcaggctgtgcactgtggctcatgcctgtaatcccagcactttgagaggccgaggtgggaggatcacctgaggtcaggagtttgagaccagcctggccaacatggtgaaaccccatctctactaaaaatacaaaaattagaggccaggcgtctgtaatcccagctactcgggagactgaggcaggagaattgcttgaacctgggaggtggagtttgcaatgagttgagaccgcaccattgcactccagcctaggcaacaagagtgaaactccatctcaaaaaaaaaaagaaaaattagctgcgtgtggtggcacctctagtcccagctactcagcaggctgaagcacgagaatcacttgaacctgggaggcggaggttgcaatgagccaagattatgccactgtactccagcctgggtgacagagcgagaccctgtctcaaataaataaataaataaagagaattcataaacaccctgcaaggtaggtggtgttatacccattttaccaatgaggaaattggagctcagagaggtgaagtgacttgctcaaggtcacccagctaataaaggcagagctgggatgcagactcagctttgtgcagttcctgagcctctatgctgccccttcacattactcagagtgcatgtctgagcctggtctcaagctatgatatctcaagctatggtatctcaagctatggctttgagaccagcatcttctctcccagagctctacatttagcttcctctgacagtgcagaagggaatccatctccttttttgtggaggctgtgaagccccatggctagtcttgccccaggcctacctgtgggctgccctatgagccgcctgcagcattgctcaccttctcagcagtctggcatctcattgaaagaaaggaatgatggtccttaagaactccacttccgaagactgtccctccatagttagagcaaattcattcccttgctgggttgctgggctctggcactgcgctggccctcgttggaggtctgcagaagtgcacagaaagtgtgggcaatggactggccatttccacagttttggaaacttttaaaaatccatattcttgctgggggtggtggctcacgcctgtaatcccagcactttgggaggccgaggcaggcagatcaccagaggtcaggagttctgagacgagcctgcccaacatggtgaaaccccatctctactaaaaatacaaaattagctgggcgtggcagcaggcgcctgtaatcccagttacttgggaggctgaggcaggagaattgcttgaccgcaggaagcggaggttgcagtgagccaaaattgcgccactgcactccaacctgagcaacacagcgagactccatctcaaaaaaaaaaaaatgcatattctggcttggcgtggtggcttatgcctgtaatcccagcagtttgagaggccgaggggggtggattgtttgagtccaggagttttagaccagcctgggcaacatggcaaaaccctgttgctact

SEQ ID NO: 4977 - DNA, 1837 bp, Homo sapiens
agggcctctcgaagtgggcttgtgaatggctagattgggaagcaccggcggggtgtcgggaagggtggtgacgcaacatagagactccgcccccttccttggagcgccgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataa

SEQ ID NO: 4978 - DNA, 1772 bp, Homo sapiens
ccagagtttctgggatgtgcctcaccgggtctcactgcctgcaaaggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggtacggtctatccctagcgggggctccaaggcagcccagaagaaaatcaaggacatctgtcctcaggattcgggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacat

SEQ ID NO: 4979 - DNA, 1815 bp, Homo sapiens
ggagttcggggaggcacagggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggactgaagcttcaataggagttccaggcattaagatggatggtggagatgcacaagaacatggtcatttccttagactaccccaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgcta

SEQ ID NO: 4980 - DNA, 2686 bp, Homo sapiens
atactcctaagctcctcccccggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtgtccctcaatgcatggttctggtccacagttttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccatcagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccattgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaaggcgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctc

SEQ ID NO: 4981 - DNA, 1134 bp, Homo sapiens
atactcctaagctcctcccccggcggcgagccagggagaaaggatggccggcctggcggcgcggttggtcctgctagctggggcaggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtgtccctcaatgcatggttctggtccacagttttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactc

SEQ ID NO: 4982 - DNA, 2533 bp, Homo sapiens
atactcctaagctcctcccccggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaaggtgtccctcaatgcatggttctggtccacagttttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccatcagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccattgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaaggcgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctc

SEQ ID NO: 4983 - DNA, 970 bp, Homo sapiens
atactcctaagctcctcccccggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctggaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtg

SEQ ID NO: 4984 - DNA, 1527 bp, Homo sapiens
agttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtattttcccactta

SEQ ID NO: 4985 - DNA, 1623 bp, Homo sapiens
agttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggctggtatgcaatggcgtgatctcggctcaccacaacctccgcctctggggttcaagtgattctcctgcctcagcctcccgagtagctgggattacaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtattttcccact

SEQ ID NO: 4986 - DNA, 3839 bp, Homo sapiens
actcgcctggagcgcgcgggcaaggcgggcggagcgcactggaactcaagggggcgcacagcggcgcgctcgcaccgctcggctccgcgcggctctaggaggtggcggcggtggcggtggcggcggtggcggcggcggcggcggcggggcgcagggctgagcgagcgtccgggttccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaagtttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggtt

SEQ ID NO: 4987 - DNA, 6214 bp, Homo sapiens
gcgggcaaggcgggcggagcgcactggaactcaagggggcgcacagcggcgcgctcgcaccgctcggctccgcgcggctctaggaggtggcggcggtggcggtggcggcggtggcggcggcggcggcggcggggcgcagggctgagcgagcgtccgggttccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaagtttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggttaaaaaaaaaaaaaaaacaggtaccaggttctgtgtgtttgcaccaagtaattgacatgttttttaatacatgtggaccatgaacagtattcattctactttttcaaatgatatgctgtagaaaatattccttgaagatgtgagatttaaaaatttttccctttcaatgttgttatgtattctactggtttttgattgatagcacagtgataaatcataatactagacaaaattgtcttctctttcaaaccagagccatatatatgtctgtatatatgggacctactgcttctctgaggaaatgcataatctgttaatatcagacaaaatgagcaattggcagtgctcataatatattccaatttttattggaattttcgatggaatgttatttcaataaagccatgtaaggtgaaactttgataactttttactcttcaagttagggtaaattctgatccaatattcaattcatttgtgtactcccacatgcaaaatgctaaattacaatgcagacattaagaaaaagtattgactggaggggttgaattccttgagaatttattttatagtctaaatcacaaatactttactcaatttagtttttaaaatagtaaactgaatatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgtcaacagttttggacaataaaaatctgaaagtattaacacttgattttctactggggcccttcaaacttggttggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactccttt

SEQ ID NO: 4988 - DNA, 1691 bp, Homo sapiens
aggggcgggcagccaggggcacttccgctggcccaagtgatctgcatgtggcagggctgcgcagtggagcggccagtgggcaggatgacgagccagacccctctgccccagtccccccggcccaggcggccaacgatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaagtgtaccgtgaggctcagttctacgaaatcaagcctttggtcaagctgctggaggacatgccacagatctttggtgagcaggtgtctcggaagcagtttttgctgcaagtgccgggctacagcgagaacctggagctcatggtgcgcctggcacgtgcagaagccataacagcacggaagtccagcgtgcttgtgtgcctggtggaaactgaggagcaggatgcatattattcagaggtcctgtgttttctgcaggataagaagatgttcaagtctgttgtcaagtttgggccctggaaggcggtcctagacaacagcgacctcatgcactgcctggagatggacattaaggcccaggggtacaaggtattctccaagttctacctgacgtaccccaccaaaagaaacgaattccattttaacatttattcattcaccttcacctggtggtgatcctcaggagcagagactgttatgaattctggcgtggcttatgaaattaaaagttgccatcaaagccattttcttttaatttcacaaacatcaggcaatttccagggttggtctagagtcttgccactaaatattgatcactcgtttaaggactttccactccattgcaactgatgccactatatttgcctagcaacttgcagctacttccttttcaaagcctcatgtatctcccagacccttctcttgaagtccaataacaagaccaagtaagaatgtttcaacaatgcgttggcaagagatgtgagatgacaacaggaacatacaagatactgtgaatctagatgttctgacctaaagatgtagtctacatagccccagcttggggtccaatccatctgtccctggcatgtgccttcatgtagtaggtgctttcctgatcccctttgcgagatgctgtgggtgctaacacctcagagctgtcctcttctctagagtggaggttttcaaagtgcatcatcagcattacctgtgaacttgctggaaatacaaatcctcaggccccacctcagacctactgaatcagaatctctgggggttggcacagcattctgatttaccaaaccctccaagtgattttgatgtattctaattttgagaccatctctagaaaagaattgctacctcttgtatggaggtacaaaagactgacctcttacatcaaggaacttcctttcccagagctcctcatggaatcaagctgaagtcagtcttcttctgagagcacattcttactcagtttttttcctctgtcctacgctgcttccctcactccccttctcctaagagcactccatcaataaaccacttgcacgaga

SEQ ID NO: 4989 - DNA, 904 bp, Homo sapiens
actgagccgatctctttctttcctgctcctgcccttgcgaactgattctgtggactccttttttgctgtttctgggggaaatctcggcagatcactcgcttttctcggagtcctccccggtttactgtcagggggtgacattggcctctgttgcttgtccccaggatccctctctgacacccctgctgtgtttgctgtggggagttctgctgccaccacccattagatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaagtgtaccgtgaggctcagttctacgaaatcaagcctttggtcaagctgctggaggacatgccacagatctttggtgagcaggtgtctcggaagcagtttttgctgcaagtgccgggctacagcgagaacctggagctcatggtgcgcctggcacgtgcagaagccataacagcacggaagtccagcgtgcttgtgtgcctggtggaaactgaggagcaggatgcatattattcagaggtcctgtgttttctgcaggataagaagatgttcaagtctgttgtcaagtttgggccctggaaggcggtcctagacaacagcgacctcatgcactgcctggagatggacattaaggcccaggggtacaaggtattctccaagttctacctgacgtaccccaccaaaagaaacgaattccattttaacatttattcattcaccttcacctggtggtga

SEQ ID NO: 4990 - DNA, 3676 bp, Homo sapiens
gatgcacaaatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttattttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctcccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtcttttttttttttttttttaaagctactgcttgactgttccttagaataaataaaggatattttataaattaca

SEQ ID NO: 4991 - DNA, 3932 bp, Homo sapiens
gggggcgagagagaaagtaactccaggacgagaccggagcgacccgcgcagcgagcataggcggcgaagctgcgcccggcgcccgagaccggcagctgcgtggggcgggggctgcgcccgagcccgatctgccggctccgagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttattttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctcccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtcttttttttttttttttttaaagctactgcttgactgttccttagaataaataaaggatattttataaattaca

SEQ ID NO: 4992 - DNA, 1691 bp, Homo sapiens
gatgcagacgccgcggccggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcacgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 4993 - DNA, 1763 bp, Homo sapiens
gatgcagacgccgcggccggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcacgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaagcccagtcatctcaggatcccgctaaccttttctccctcccaccactgcctcctcctccgcttcccgctggaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 4994 - DNA, 559 bp, Homo sapiens
attagaagctctccagccgccccggatcggggcctctccttctcctttggggctgtggacagggagagacctgggacctttcctccctcccaaaggggactcctgctctggggaaggagtcgacgaggctacttctcccgctctttgggatgtgggtggcggatgggtgcagggagctagctggatggaggagccctggggcgccttctgagcgggctgaatctagaaggagcgttggcccagcgggcactatttctgagcacccaccctgactctgctgcacactgcctgccgcgaccttgagtcggacccttccctgcactgcgctcagcctccttcctcatctgtaacacgaagggctggtctgaagatgacctctaaggtctcctgtcccccatccgtgaccctccgatgctgtggcctttggcaagtcgcctcacctctcaatgtctccgatctctctgatgagaccggggcctacctcattgaccgtgaccccacctacttcgggcccatcctgaacttcctccggcatggcaagctggtgctggacaaggac

SEQ ID NO: 4995 - DNA, 1438 bp, Homo sapiens
ggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcacgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaac

SEQ ID NO: 4996 - DNA, 2940 bp, Homo sapiens
cgcgtccgccccgcggcgtccggcggccgcgccgagggtctggcgggccgcaggtcagtctgggaagctgccgacccgccccacccccccggtgcggaagagccgggcgcgggatgggccgcgggcccggaaggcggcggggcgccctgaggaagggcacgggccgcgctggtaacgcgcgcgccccgggctgcaggctcgggcttcgggccgatttggggtctccaggccgcggaagaccgtggcggggctttctggctccccagctcctcccggctcttcccgcttcggaagaggagtgtgagccccttgagcgatgtttttcaaagtggggttcgcgggcagatcccgacccctcctcagactttctgaggaactgtgtgctgtggccggagtgtcttcgttttcccaagcgtccctgatggttttgatgcagagggagaccaagacatcattgttttgaagtttctgaaagtgttgggcggcaaaaattcaggtgcctgggggagaaatggaaggccacaaggcagaagaagaggtgctagatgttctccgactgaacgtgggtggctgtatttacacagcccggcgggagtccttgtgccgcttcaaggactccatgttggcatctatgttcagtggtcgctttcctctaaaaacagatgagtcaggggcttgtgttattgaccgtgatggacgtctatttaaataccttttggattaccttcatggagaagttcagattcccacagatgagcaaacccgcatcgccctacaggaagaggctgattactttggcatcccttatccatacagcctgtctgaccatttggccaatgaaatggagacatattctttaaggtcaaatatagaacttaaaaaggctttaacagacttctgtgattcatatggcttagtctgcaataaaccaacagtttgggttctccactatcttaacacatctggtgcaagctgtgagagtagaattattggtgtatatgccacaaaaactgatggaacagacgctattgaaaagcagctgggaggaagaattcacagcaaaggcatttttaaaagagaggcgggaaataatgttcagtacatttggagctattattcagtagcagagttgaagaaaatgatggatgcctttgatgcttgggaaggaaaaggtgttagctactggcgggtgcctcatgagctgatagagtgttggactctagaagaacggcctttacttggaagcctgcgtcacatggctccaattcgaaagaggcgactgataacgttcaatgaagcggacgaaagtgtgaactataagactggtcctaagccagttagatttttgggcccttccacaagtacccaaattaaagtcaagaactcggcctcagtcacggtgtctccagccagtgccatccagacgtcggctggggcgacagcaaaccggtttcaaagtggtagccgcagaaaggcagctcagcgctctgcaccttccagagccacggccctggtgggcacgggggcacctgggcatcctcaggcttcccctggggctgcgagcgctgaaaatggaggcacgcacttacctccagctaaggtgctactctccgacaagaagcctacaccccagcgggtgataaagctgaagaggactccgctgtgcgccaccgcgccttgcctgccctcccccacggccacgaggcaggccaactccctcaagccgcttcccggcgaagctgcccgtgccttgggagtgcggactgagaacgggaagaacaagggaaattgatgaaagtggtggacttgaaatttcccgttcatctcccaaagctttcaacccattcgacgcaaagaagtgacactttcttaatgcagcagaggggaagcttaggtttatgttgaggattctgttcctggaattgtgtgagctaggaatggaggaggggagactttcaatggttaaggctccatttctcattttcccaacttttatatgattgtctatgggcagtttgaatttctggttttcaatttattttttaatgattaattcgtattaaggcaacaagacagtacaacaaataatctctagagaggtccactttgttgctgaagtaaacgttacttgttgcaacccgaggatgggcatgaggtttggccttaggtattcctgtctgggaaaatggagggggtgatattagtggttccctgtactatatcacagccaagagagattagagagagaaaatgtagatcaaggcgagctgcctacaaattactctgtctccaaaggcaacgtgaaaagaaatgatggggaggaaaaaaccccatagattgaattagcactttgactctcacttaattcaacgattttctttcctagattggcttttcttactcttttctgttagtagatttatttataaacaccacaagaagatctcttgggatcagaattatataatatctttgaagtaaattattaaaatatcctatttaatttgaatagtgaagttttgaaaatactttgaaaaagagaagtaaaagtttaactttttaactaaagttagtatttgtttttcagaaatgaccactgaagattcattctgattatacaatatgatttttatgcataaaatttccatgtaacttgaatttaatatttttaaacagaatattttgactaatcctctattttttcatgactattcagttgtgtgtgtttattcgtaaatgttatgttttgtaattggatcacatatttctactttcagtgagagtatgccttcactatgttaaaaaataagctcataaaacagggtactttttattcaaatgcttatcattgtactttcattgctttgaaagagtaaagtaagtatactcaaaacattacgttttacaaaatcaaataaaacttttccataaaaagtggta

SEQ ID NO: 4997 - DNA, 2556 bp, Homo sapiens
acttccgcgtccgccccgcggcgtccggcggccgcgccgagggtctggcgggccgcagagggagaccaagacatcattgttttgaagtttctgaaagtgttgggcggcaaaaattcaggtgcctgggggagaaatggaaggccacaaggcagaagaagaggtgctagatgttctccgactgaacgtgggtggctgtatttacacagcccggcgggagtccttgtgccgcttcaaggactccatgttggcatctatgttcagtggtcgctttcctctaaaaacagatgagtcaggggcttgtgttattgaccgtgatggacgtctatttaaataccttttggattaccttcatggagaagttcagattcccacagatgagcaaacccgcatcgccctacaggaagaggctgattactttggcatcccttatccatacagcctgtctgaccatttggccaatgaaatggagacatattctttaaggtcaaatatagaacttaaaaaggctttaacagacttctgtgattcatatggcttagtctgcaataaaccaacagtttgggttctccactatcttaacacatctggtgcaagctgtgagagtagaattattggtgtatatgccacaaaaactgatggaacagacgctattgaaaagcagctgggaggaagaattcacagcaaaggcatttttaaaagagaggcgggaaataatgttcagtacatttggagctattattcagtagcagagttgaagaaaatgatggatgcctttgatgcttgggaaggaaaaggtgttagctactggcgggtgcctcatgagctgatagagtgttggactctagaagaacggcctttacttggaagcctgcgtcacatggctccaattcgaaagaggcgactgataacgttcaatgaagcggacgaaagtgtgaactataagactggtcctaagccagttagatttttgggcccttccacaagtacccaaattaaagtcaagaactcggcctcagtcacggtgtctccagccagtgccatccagacgtcggctggggcgacagcaaaccggtttcaaagtggtagccgcagaaaggcagctcagcgctctgcaccttccagagccacggccctggtgggcacgggggcacctgggcatcctcaggcttcccctggggctgcgagcgctgaaaatggaggcacgcacttacctccagctaaggtgctactctccgacaagaagcctacaccccagcgggtgataaagctgaagaggactccgctgtgcgccaccgcgccttgcctgccctcccccacggccacgaggcaggccaactccctcaagccgcttcccggcgaagctgcccgtgccttgggagtgcggactgagaacgggaagaacaagggaaattgatgaaagtggtggacttgaaatttcccgttcatctcccaaagctttcaacccattcgacgcaaagaagtgacactttcttaatgcagcagaggggaagcttaggtttatgttgaggattctgttcctggaattgtgtgagctaggaatggaggaggggagactttcaatggttaaggctccatttctcattttcccaacttttatatgattgtctatgggcagtttgaatttctggttttcaatttattttttaatgattaattcgtattaaggcaacaagacagtacaacaaataatctctagagaggtccactttgttgctgaagtaaacgttacttgttgcaacccgaggatgggcatgaggtttggccttaggtattcctgtctgggaaaatggagggggtgatattagtggttccctgtactatatcacagccaagagagattagagagagaaaatgtagatcaaggcgagctgcctacaaattactctgtctccaaaggcaacgtgaaaagaaatgatggggaggaaaaaaccccatagattgaattagcactttgactctcacttaattcaacgattttctttcctagattggcttttcttactcttttctgttagtagatttatttataaacaccacaagaagatctcttgggatcagaattatataatatctttgaagtaaattattaaaatatcctatttaatttgaatagtgaagttttgaaaatactttgaaaaagagaagtaaaagtttaactttttaactaaagttagtatttgtttttcagaaatgaccactgaagattcattctgattatacaatatgatttttatgcataaaatttccatgtaacttgaatttaatatttttaaacagaatattttgactaatcctctattttttcatgactattcagttgtgtgtgtttattcgtaaatgttatgttttgtaattggatcacatatttctactttcagtgagagtatgccttcactatgttaaaaaataagctcataaaacagggtactttttattcaaatgcttatcattgtactttcattgctttgaaagagtaaagtaagtatactcaaaacattacgttttacaaaatcaaataaaacttttccataaaaa

SEQ ID NO: 4998 - DNA, 2911 bp, Homo sapiens
ccgttattggccgggtcacaagcccgcccgcccgctgctggagccgcgaccatggaggagtctggcatggctcatgaatcagcagaggacttgtttcatttcaacgtagggggctggcatttctcagttcccagaagcaaactctctcagtttccagactccctgctgtggaaagaggcttcagccttgacctcttcagaaagccagaggctatttatcgacagagatggttccacatttaggcacgtgcactattacctctacacctccaaactctccttctccagttgtgcagaactgaacttgctgtatgagcaagcattgggtttgcagctgatgcctttgctgcagactctagataacctgaaggaagggaaacaccatctacgcgtacggcctgcagacctacctgttgctgagagagcatctctgaactactggcgtacatggaagtgtattagcaaaccctcagaatttccaattaaaagcccagcctttacaggcctacatgataaggcacctctggggctcatggacacacccctgttagacacagaagaggaggtgcactactgcttcctgcccctagacctggtggccaaatatcccagcctagtgactgaagacaacctgctgtggctggctgagacggtggccctcatcgagtgcgagtgcagcgagttccgcttcattgtgaattttcttcgctcacagaagattttactaccggataatttctccaacattgatgtattagaagcagaagtggaaattctggaaatccctgcactcactgaagccgtaaggtggtaccggatgaacatgggtggctgttccccgaccacctgttctcccctgagccccgggaagggggcccgcacagccagcctggagtccgtgaaaccgctctacacaatggccctgggtctgctggtcaagtacccggactctgcgctgggccagcttcgcatcgagagcacgctagacggaagccgactgtacatcacagggaatggcgtcctctttcagcacgtcaagaactggctggggacttgccggctgcccctgacagagaccatttccgaggtatatgagctctgtgccttcctagacaaaagggacatcacctacgagccaatcaaagttgctttgaagactcatctggagccaaggactttggcacccatggatgtgctcaatgagtggacggcagagatcactgtgtattccccacaacagatcatcaaagtgtatgttggaagccactggtacgcaaccaccctgcagacactgctgaagtatccagaactgctgtccaaccctcagagagtgtactggatcacatatggacaaaccctgctcatccacggggatggccagatgttccgacacattctcaacttcctgagacttggcaaactgtttttaccatctgaatttaaggaatggcccctcttctgccaggaggtggaggaataccacattccatccctctcagaagcccttgcacaatgtgaagcatacaagtcatggactcaggagaaagaatctgaaaatgaagaagctttttccatcaggaggctgcatgtggtgacagaagggccagggtcactggtggagttcagtagagacactaaagaaaccacagcctacatgcctgtggacttcgaagactgcagtgacaggactccatggaacaaggctaagggaaacctggtcaggtccaaccagatggatgaggctgagcagtacactcggcccatccaggtgtccctatgccgaaatgccaagagggctggcaaccctagcacatactcacactgccgtggcttgtgtaccaatcctggacactgggggagccaccctgagagccccccaaagaagaaatgcaccacaatcaacctcacacagaaatctgaaaccaaagaccctcccgccactcccatgcaaaaactcatctccctggtgagagaatgggacatggtcaattgcaaacagtgggaattccagccactgacagccacacggagcagccccttggaggaggccaccctgcagctccccttgggaagcgaggctgcttcccagcccagcacctcagctgcctggaaagcccattccacagcctcagagaaggatccaggaccacaggcaggggctggagctggagcgaaagacaaggggccagagccaaccttcaagccatacttacccccaaaaagagctggcaccctgaaggactggagcaagcagaggaccaaggagagagaaagccctgcccctgagcagcctctgcccgaggccagtgaggtggacagcctaggggttatcctcaaagtgactcacccccccgtggtgggcagcgatggcttctgcatgttctttgaggacagcatcatctataccacggagatggacaacctcaggcacacaacacccacagccagtccccagccccaagaagtgactttcctgagtttctctctgtcctgggaagagatgttttatgcacagaaatgtcactgcttcctggctgacatcatcatggattccatcaggcaaaaggaccccaaagccatcacagccaaggtggtctccctggccaatcggctgtggaccctgcacatcagccccaagcagtttgtggtagatttgctggccatcaccggcttcaaggatgaccggcacacccaggagcgcctgtacagctgggtggagcttacactgcccttcgccaggaaatatggccgatgcatggacctgctcatccagaggggcctgtctaggtctgtctcttactccatcctgggaaagtacctacaagaggactagggtgcccagagatgcagcccctcatgccccacccgccaagtctcattttaattggagatagcccagaatgcatgtgccc

SEQ ID NO: 4999 - DNA, 5619 bp, Homo sapiens
taacttttccgtctgcaacctttaataattgagagggtatgcgcaactcagaaaagtgcgcccgctgaggttgggtgcagagtggactggaggaaaggcgacacccatttacggtgcggccccggacggggtccccagacacggccttcccggcgtgccacgcgcggaggggactcttaacgtgaagcgctgggtgactcagccgcgtggccgcgcggtccggggcggggggcgcgcgccgctgcggcacagccggtcccggctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgtg

SEQ ID NO: 5000 - DNA, 4094 bp, Homo sapiens
gctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaaggtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaa

SEQ ID NO: 5001 - DNA, 597 bp, Homo sapiens
ctggctgcgcggcctgcgcgcgcctcccgggcggattccagccccgagcgggacagcgcggcggggagcgacgagatgaggtgtagtggcaagatttcagctcactgcagctttgacctccgggcttaagcagtcctcccacgtcagccttgcccaagtagttgggactacagatgaagtctcactctgttgcccaagctgcagtgcaatgtcgctatcttggcttactgcaacctccgcttcccgaagcgattctactgccccagcctcctgagtagctgggactacaggatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaat

SEQ ID NO: 5002 - DNA, 578 bp, Homo sapiens
gctgcggcacagccggtcccggctgcggcttctggctgcgcggcctgcgcgcgcctcccgggcggattccagccccgagcgggacagcgcggcggggagcgacgagtgcaaggaatatgtagagataattccactatcaaagactgtatatacattttccaagatggggagatgatggtgataaaactattttgctgttccaggatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaa

SEQ ID NO: 5003 - DNA, 547 bp, Homo sapiens
agccggtcccggctgcggcttctggctgcgcggcctgcgcgcgcctcccgggcggattccagccccgagcgggacagcgcggcggggagcgacgagcctcgggtggttcatcccgccggagaggaatggcgagaacctggagtgttgactggcaaaacatttgcagacgcggtttttctggcaattaattggctccattaaaaattaggatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaataaacggaaccatgaaccttttattgctccaga

SEQ ID NO: 5004 - DNA, 1339 bp, Homo sapiens
ttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttg

SEQ ID NO: 5005 - DNA, 1494 bp, Homo sapiens
ggtcccggctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaaggatgtttggaccaggaagagagtacaacttcactcggcccaatgagaagggagagtatgagattgctgaaggcatcagtgcaactgtatttcgcacagtgctggtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattctt

SEQ ID NO: 5006 - DNA, 3585 bp, Homo sapiens
aaggccagccggccggacaccggcggggacgaggcggggcgcagagcaactcgctgcaatgcctcctgggagatggagttcgctctcgacgcgccgagctgcgaggagcccagagagaactaccagtcccggaaggcagcgcacagaccccggaccgccacgcccctgggctgggctcctaccctccgcccccctcgcaaagctgcgctggccgctcgcggagggagaggctgcagagcgagggcaggaggactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacactgaaccagcgtgtgcagacggtccacttcactgtgcgcgaggcaccccagatctacagcctctcctcttccagcatggaggtcttcaacgccaacatcttcagcacctcctgcctcttcctcaagctccttggctctaagctcttctactgctccaatggcaatctctcctccatcaccagccacttgcaggaccccaaccacctgactctggactgggtggccaatgtggagggcctgccagaggaggagtacaccaagcagaacctcaagaggctctgggtggtgcccgccaacaagcagatcaacagcttccaggtcttcgtggaagaggtactgaaaatcgctctgagcgatggcttctgcatcgattcttctcacccacatgctctggattttatgaacaataagattattcgattaatacggtacaggtaaaaggaccccaacaacactggagatggggagtcccaggaagctcatgtcagccaggtcttggagggcatctcgccagtggtgcgaggcaggggactatactaatctgtattaattgtgtagcaggacttgattccccccatgatgaagtccaccttttggaatccagtgtcctctgaacagaaccaccttttttcttgccattttgagctgcagacaggcggtttattatgacaagtgaagagtcagctgatgtgtactaaaggaggccataggaggattttccagccaggacaaaagagcagcagttttctcctgggctccatctctctgtaccgctagccagtgccgcatttatccatctgtaagaaggccctggtggagaggatgggatgagaacaagaggctacctccagttaaccaggacataaagtccccagcggttcctgtcacacctgctcctccctccccagggtgcatccatgatcgtggatgtttgcccaggggtgaccatgtttggctggcttggaatgctgtgcattctcagagctctgttagtgtcccctcttgggggtcagagatgaggtgtggcagggtctagaggaatgagtgtccaggcagagttcagaaggtaggaatgtccctcttgatagggctgaatcaagggattcctggctttagaaagggtctgctatctttgcaaaaatgtgcaagtatctgtagccagtgtaatgaaatcacttccaaatccagcctgttacctgacttttgtcattgttttcccaaaaatttgaggtatcattgaaacaggtcattttaaacaaatctattacggattctcagggttggaaataattcgatgattgcttagtcctcccccacccctagaacaccccagcacatctgaagatgagcgcctctccctgggtacctgcaagtgatcaccttggcctgcttgcataccttggctgataggaagcgcgccatccccaaggcagctcctgctgtggttggacagtgctgactgttagacagttcttccctatattgagccaaaatctgtcctgccacttgctggatcttggttgcagaccttcccattcacccagttatatatctttgctttcaaaatagtcaccttgagagaccagacatttttctgaaaacatcattactcagaattcagattcccctctgggatctgtcttcagaatcaaagttagctcttttctatcccctgtaagtcagtccccttttgttgtagcttcacctcgtttgtgacccccacttcacccaccttccccaccatctgtggctccatatacctttcgaccattttctgctggaagaggaagattcacggcccctgaggagatccagaggaaagagacggtctccaagggtgctgtgcagcaaggagcccaggagtggtatgaaccgtaacagtgcccttagagtaaatgtgcggcccctaagaccctgccctcaggaaggcggccttcccctgcagtcctgtgtcccacccctgggtctctgtagggtgccatccagggcaagcaacccaagcactgcttcccaccgggtgatgagccatgcaggcctccaaactgcacgtcatgattcatccctaaagtgagtttggccttgagagtccccagggtcctcccccactgggcaggggtcctcaaagccaaggaagcctggtgacacaggcacccatgggaggtgggcccagaaaggggcttcccatagataggccctgtgagtagggagcttgtacactgggccatgggcagcgccagttcccttgagcagtaaaggcccttttccccctacggtgggacccaggagtctctctgacagcttttctgccaggcacagtggctcatgcctgtaatcccaacactctgggaggccgaggcgggaagatcacttgaggtcaggagttcaagaccagcctggccaacatggtgaaacgtcgtctctgctaaaaatacaaaaattagctgggtgtggtgacaggcgcctataaccccagctatttgggaggctgaggcagtagaatcgcttgaacccagatagcagaggttgcagtgagctgagagtgtgccattgcagagagactccatcccaaaaaaagacagctgtcccaggccaagggtacttgggagagcccctcatggagaacctagtttagaccaagtagcagaagctgtggtcataacaaaacaatttgaggaagaaatcttacaaatcaccactgccctttctccttttccataaaactgtccatcttttcggtgctccctaatccaagcagcttgactttagagaagttgcagaagcagtgaagccactaacatgctgtgtgactttatgcaagtcactcacctcactgagccacctccatttcttcatctgtgaaataggcataacagtaatacataaccctacctacctcacagggctgttgtgaggatcaaatgaaataatgtaacgtgagaatacagtataaatgataaagga

SEQ ID NO: 5007 - DNA, 499 bp, Homo sapiens
tgacagcaaaggacaggccaccaggagccaagagcatcttcatggcaaggactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacactgaaccagcgtgtgcagacggtccacttcactgtgcgcgaggcaccccagatctacagcctctcctcttccagca

SEQ ID NO: 5008 - DNA, 1865 bp, Homo sapiens
gcaaaaccgagctgacagcgcaggcgatgctgccagcgtttccattccatcaccaggctggggctgaataaaggcgtgcttgtgtggtagtgtctctttttaaaaaatctcaaagccaagaagaacaagctgaaatagcatcttcaaaaaatggagcgtaaaataaacagaagagaaaaagaaaaggagtatgaagggaaacacaacagcctggaagatactgatcaaggaaagaactgcaaatccacactgatgaccctcaacgttggtggatatttatacattactcaaaaacaaacactgaccaagtacccagacactttccttgaaggtatagtaaatggaaaaatcctctgcccgtttgatgctgatggtcattatttcatagacagggatggtctcctcttcaggcatgtcctaaacttcctacgaaatggagaacttctattgcccgaagggtttcgagaaaatcaacttcttgcacaagaagcagaattctttcagctcaagggactggcagaggaagtgaaatccaggtgggagaaagaacagctaacacccagagagactactttcttggaaataacagataaccacgatcgttcacaaggattaagaatcttctgtaatgctcctgatttcatatcaaaaataaagtctcgcattgttctggtgtccaaaagcaggctggatggatttccagaggagttttcaatatcgtcaaatatcatccaatttaaatacttcataaagtctgaaaatggcactcgacttgtactaaaggaagacaacacctttgtctgtaccttggaaactcttaagtttgaggctatcatgatggctttaaagtgtggctttagactgctgaccagcctggattgttccaaagggtcaattgttcacagcgatgcacttcattttatcaagtaattacctgtgtcacgaacaaaggcaacaagcatgcagccagcaagcttcggaaaaccacagcatcaaagacatcccaaataacatgcccagctagctctgtactacagagccctgctactaatcaattactgtgagctaacggtatgtaaattctatcgctaaagatgtccttcctctggggtgttcctactgatcagactcttccacctaaaatgaaaacagtaaccttctatatactgtaaataaagactgaaagcttttgctatttatttgtccttaagctgtctttcaattcagattgtcttgggtatttgcacaaaaaagaaagcatgtacattatctatcgttcatttaagtaaatggtaataaaatattttaaggggctattaatatttaaaatccttttctactatggcaaaaatctacagagaaactgaactggcaaaattaactacctggagcaaaacagatgtgcagatctaactaaaacagagctatagtgaaacaaaatgagattgtaagaagacattaaagctattgatttgatttttccatagcaagcaccaaaagcttatattcacagttcctgtgtttcatattagacttatagctgaattggtattttgctgaaaattcctagaaaactgcttgatgacaataaaaagtaaataaaagcactgctaccttctttgattgtattaatgattataataaaaagttacaggtcactttaaaagcaaacagtaccacttgatgattttgcataaaattatgcattgatgtcaaccggcaggctacaggaaccctggctggtcctggaagtgacaaaaaccagcaaattcaattctttgcaggctgagttcccacaaagcatgggtaacttagtctcaatagagtatctgttattagaataataaaggagttcattttcagaa

SEQ ID NO: 5009 - DNA, 2115 bp, Homo sapiens
tttccacaagaccttctggatccagctgaatgtggaggcctttaagagaacttccagctcctgtaaaaacccagaccagaggactactgaccaacatttcaggctgatcctccagacctcgaagttactctccttactctcctgactcttaattacatcacacctgtgtcgacactctctgggaaaagactgaagaaataatcttttcaagaagcagaaagctcctgcatacataggctgatacgccacctactgcaaaaccgagctgacagcgcaggcgatgctgccagcgtttccattccatcaccaggctggggctgaataaaggcgtgcttgtgtggtagtgtctctttttaaaaaatctcaaagccaagaagaacaagctgaaatagcatcttcaaaaaatggagcgtaaaataaacagaagagaaaaagaaaaggagtatgaagggaaacacaacagcctggaagatactgatcaaggaaagaactgcaaatccacactgatgaccctcaacgttggtggatatttatacattactcaaaaacaaacactgaccaagtacccagacactttccttgaaggtatagtaaatggaaaaatcctctgcccgtttgatgctgatggtcattatttcatagacagggatggtctcctcttcaggcatgtcctaaacttcctacgaaatggagaacttctattgcccgaagggtttcgagaaaatcaacttcttgcacaagaagcagaattctttcagctcaagggactggcagaggaagtgaaatccaggtgggagaaagaacagctaacacccagagagactactttcttggaaataacagataaccacgatcgttcacaaggattaagaatcttctgtaatgctcctgatttcatatcaaaaataaagtctcgcattgttctggtgtccaaaagcaggctggatggatttccagaggagttttcaatatcgtcaaatatcatccaatttaaatacttcataaagtctgaaaatggcactcgacttgtactaaaggaagacaacacctttgtctgtaccttggaaactcttaagtttgaggctatcatgatggctttaaagtgtggctttagactgctgaccagcctggattgttccaaagggtcaattgttcacagcgatgcacttcattttatcaagtaattacctgtgtcacgaacaaaggcaacaagcatgcagccagcaagcttcggaaaaccacagcatcaaagacatcccaaataacatgcccagctagctctgtactacagagccctgctactaatcaattactgtgagctaacggtatgtaaattctatcgctaaagatgtccttcctctggggtgttcctactgatcagactcttccacctaaaatgaaaacagtaaccttctatatactgtaaataaagactgaaagcttttgctatttatttgtccttaagctgtctttcaattcagattgtcttgggtatttgcacaaaaaagaaagcatgtacattatctatcgttcatttaagtaaatggtaataaaatattttaaggggctattaatatttaaaatccttttctactatggcaaaaatctacagagaaactgaactggcaaaattaactacctggagcaaaacagatgtgcagatctaactaaaacagagctatagtgaaacaaaatgagattgtaagaagacattaaagctattgatttgatttttccatagcaagcaccaaaagcttatattcacagttcctgtgtttcatattagacttatagctgaattggtattttgctgaaaattcctagaaaactgcttgatgacaataaaaagtaaataaaagcactgctaccttctttgattgtattaatgattataataaaaagttacaggtcactttaaaagcaaacagtaccacttgatgattttgcataaaattatgcattgatgtcaaccggcaggctacaggaaccctggctggtcctggaagtgacaaaaaccagcaaattcaattctttgcaggctgagttcccacaaagcatgggtaacttagtctcaatagagtatctgttattagaataataaaggagttcattttc

SEQ ID NO: 5010 - DNA, 2460 bp, Homo sapiens
aaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggatgaaacaggcgcctatttaatcgacagagaccccacctactttgggcctgtgctgaactacctgagacacggcaagctggtgattaacaaagacctcgcggaggaaggagtgttggaggaagcagaattttacaatatcacctcattaataaaacttgtaaaggacaaaattagagaacgagacagcaaaacatcgcaggtgcctgtgaagcatgtgtaccgtgtgctgcagtgccaggaggaggagctcacgcagatggtgtccaccatgtccgacggctggaagttcgagcagttggtcagcatcggctcctcttacaactatgggaacgaagaccaagccgagttcctctgtgtggtgtccaaggagctgcacaacaccccgtacggtacggccagcgagcccagcgagaaggccaagattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 5011 - DNA, 2425 bp, Homo sapiens
tgtacaaagagaaatacatcattatttaaaagcatcatcttttttttttatattgtaagataaataccattctgatgtatttctcttggaaagggatgctggtatcctgggaggtttatgatttttgatgtttttactcaggtgattggcttgtatagctgaaatgctgatgaaaaggagttttcccttctccctttttcttttcttttctttttttttttttttttgagatggagtctcgcactgttgcaggggctggtgtgcagtggcacagtctcggctcactgcaacctccgcctctcgggttcaagtgatgctcctgcctcagcctcctgaatagctaggattacaggtgcccaccaccacgcccagctaattttttgtatttttagtagagatggggtttcactatgttgggcagtctggtcttgaactcctgacctggtgatcctcctgcctcagcctcccaaagtgctgggattataggcatgagccactgcgcccagcctgtccctttttcttaaatgacctttttggtgaggaccattataggtttgtaccaggataaggttgtagagttaatcataatattctcttatataaattctaaaaattgatgttctaagaagagaggtagaatttgaatgactgggttacttcctagactcttcctccttctcttaagtacagtatagttctttctctgaaaatcttcagtctcttagttccagatgggttctctatggtaagaatacaggacatgtagaaggccctaggggaatgctttcttccccagatctttgccctgtagtaggtttcagctgagcaaggacgagtagtttttctggtgtttggcctcctctgttgggtggaaaaagactttcttctctattttcctagttatatatgctatcatatgtctgtttttctcctcttgaagtttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaacaaaactaataaaaaatgaaatatgaaaattaa

SEQ ID NO: 5012 - DNA, 1533 bp, Homo sapiens
gctctccggccgcgggcatctcccggcccggccgcagcagccgccgccgccgcgcatttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaacaaaactaataaaaaatgaaatatg

SEQ ID NO: 5013 - DNA, 564 bp, Homo sapiens
ctacaggacctccctgggaacctgttctctttccttgtcctgatgtgttactcttataggccaatttttgcctttgtgttgtgcctaaatggtgtaattaccccgttttgggaaggtggtattatcccgttttatcttgcggaaactgagggttaagaggaatgttatgattttgtgactatttgtgacagctttttaatattaggtcacttttaaacctatagcttctctcttctagaccacatggttgagaaaggagaaagagaaaatgattacttgtagagaaaaatccatttctgcagtggtatggttaaggataatctaaccataatcacattatccttgtatgcctggctacttatgctggcctgtatgtgaatgttaaccccaaagactcctttagatgtcgctgaactagttactataaaaagtatttcgctttcaaactcccacatttcaagaagagcaaaactcaatacaaggcaattttgaagtttccctgaaacctgggctcttgaagacgcatcactggagcagatggataatggagactggggctatatg

SEQ ID NO: 5014 - DNA, 1759 bp, Homo sapiens
ccggccgcgggcatctcccggcccggccgcagcagccgccgccgccgcgcaaccacatggttgagaaaggagaaagagaaaatgattacttgtagagaaaaatccatttctgcagtggtatggttaaggataatctaaccataatcacattatccttgtatgcctggctacttatgctggcctgtatgtgaatgttaaccccaaagactcctttagatgtcgctgaactagttactataaaaagtatttcgctttcaaactcccacatttcaagaagagcaaaactcaatacaaggcaattttgaagtttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaa

SEQ ID NO: 5015 - DNA, 2587 bp, Homo sapiens
acttccccgccctcgccccaaaggagcagcagctccttcttgcctctccattgccgccgccgcaccggcggagctcctctctcgcgcgtctctcctccgatggagctcgggcgccgccgacgccgccgctgccccgaaccctgagcggggccgccccggtcggaggaacgcgccgcccagtccgagggcgcagagcgccaggagcacgcggagggctggggcgcgggctccgggaacgagaaagtgcagctctctcgggtcactgggccggcggcggggggactatggctctgaaggacacgggcagcggcggcagcaccatcctgcccattagcgagatggtttcctcgtccagctcgcccggcgcgtcggccgccgccgccccggggccctgcgcaccctcgcccttccctgaagtagtggagctgaacgtaggcggccaggtttatgtgaccaagcactcgacgctgctcagcgtcccggacagtactttggccagcatgttctcgccctctagtccccgtggcggcgcccggcgccggggcgagctgcccagggacagccgggcgcgcttcttcatcgaccgggacggcttccttttcaggtacgtgctggattatctgcgggacaagcaactcgcgctgccggagcacttccccgagaaggagcggctgctgcgcgaggccgagtatttccagctcaccgacttggtcaagctgctgtcgcccaaggtcaccaagcagaactctctcaacgacgagggctgccagagcgacctggaggacaacgtctcgcagggtagcagcgacgcgctgctgctgcgcggggcggcggccgccgtgccctcgggcccgggagcgcacggtggtggcggcggcggcggcgcgcaggacaagcgctcgggcttcctcacgctgggctaccggggctcctacaccaccgtgcgcgacaaccaggccgacgccaaattccggcgtgtggcgcgcatcatggtgtgcgggcgcatcgcgctggccaaggaggtcttcggggacacgctcaacgagagccgcgaccccgaccggcagccggagaagtacacgtcccgcttctacctcaagttcacctacttggagcaggcctttgatcgcctgtccgaggccggcttccacatggtggcgtgtaactcctcgggcaccgccgccttcgtcaaccagtaccgcgacgacaagatctggagcagctacaccgagtacattttcttccgaccacctcagaaaatagtatcacctaaacaagaacatgaagataggaaacatgacaaagtcactgataaaggaagtgaaagtgggacttcctgtaatgagctctccacttccagttgtgacagccattcagaggcaagcactccccaggacaacccatccagtgcccagcaggcaacagctcaccaacctaacactttaacattggatcgcccctctaaaaaagcacctgtacaatggatacccccaccagacaaacgcagaaacagtgaactctttcagaccctcatcagcaagtcccgggaaacaaatctgtccaaaaagaaagtctgtgagaagctaagtgtggaagaagaaatgaaaaagtgtattcaggattttaaaaaaatccacattccagattattttccagagcgcaaacgccaatggcaatctgaactgttgcagaagtatgggttatagtaattgtcacattcctgcagtattttgatgacattcaatgtttactacagtgtcaccacctgactgatgtcctaacaatggtcagtgtgattcttgctgctcttccttgttgtgaacagtggatgtgggacagtattttcttttatgttttagttgttgttctttttagaaacatgattaaaaaggaaaaaatattaaatcaataagtgttaaatcaaaatggaatatctgattcaaaccattttacaagaatgaaagtaaaatgtgcatgatcaagcttagtatcttggtttttgaactctggtcaactggatatgtttgtcattttgtaacttaccaaaaacaaaccatcatatcataccaactaaaatgatatatggatgaagcaacatcaagtaaaattttagacgatggctataggacccaaatctaaagctgtctaaatgttaattcaatgaaacaagtattatttttgcatgaatacaatgttacaaataaatcacaagaaatagggaagatctgtttgttgcttggaaagaaaaaaattacaaaaaaaagcaaaaaaaaatgttttagacaaagcctataaatgtaagctgtctaggagattgaattttctttgttctggatctgtgacttttttgtgtatgtgtatggtgtttatgtatattaagatggtgtaaatatgccttatactgttatttatggcatcaacattcatttactaatgctagtcatgattattactgtgaaatgagtcttacatcgggctgtgaaaattggtataatgatgctttgaaagatcctattatcatgttaatcaaaataatagagggaaatggtaaagagctttatgtatttattaaaaaaagaaaaatgta

SEQ ID NO: 5016 - DNA, 3398 bp, Homo sapiens
ggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttgaaaaggagtttcttctcttccttttgaaaatcatcactttctgtattttgcttacatttcttcaatatgtgttgacaaccagccctgtggttctgggtagcaaaggaaatacagtataacttaatttgttatggattagtctttttgaaagtaccattaaagtaaatttatttcttt

SEQ ID NO: 5017 - DNA, 2657 bp, Homo sapiens
ggtggtctgagctggagccacgctttctgttggagggggcagctgaaggagaacagcaagacatatccggcggccctacggactcggagagctggagggaccccggagatctcaaagggacaggaaaggcagcagcagccaccctctctcccagtcaagtggtcaccagcaggactgaaggggacagcccctttgcagtggctcggcgaggagacccctgcaccctagggtcagtgcaggagcccagccgctgagccatgccgggccccgggcggcctgcagcgagcccaacccctgcacccaggtagtcatgaacagccacagctacaatggcagcgtggggcggccgctgggcagcgggccgggcgccctgggacgagaccctccggaccctgaggccggccaccccccacaacccccgcacagcccgggcctccaggtggtagtggccaagagtgagccagcccggccctcacccggcagcccccgggggcagccccaggaccaggacgatgacgaggatgatgaggaagatgaggccggcaggcagagagcctcggggaaaccctcaaatgtgggccaccgcctgggccaccggcgggcgctcttcgagaagcggaagcgcctcagcgactatgccctcattttcggcatgtttggcatcgtcgtcatggtgacggagaccgagctgtcctggggggtgtacaccaaggagtctctgtactcattcgcactcaaatgcctcatcagcctctccacggccatcctgctgggtctcgttgtcctctaccatgcccgggagatccagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcggggccctcaacaagatcaccttcaacacgcgcttcgtcatgaagacactcatgaccatctgccccggcaccgtgctgctggtcttcagcatctcctcctggatcatcgcagcctggaccgtgcgcgtctgcgagaggtaccacgacaagcaggaagtgaccagcaacttcctgggggccatgtggctgatttccatcaccttcctctccattggctacggcgacatggtgccccacacctactgcgggaagggtgtgtgcctgctcactggcatcatgggagctggctgtaccgcgctcgtggtggctgtggtggctcggaagctggagctcaccaaggctgagaagcacgtgcacaacttcatgatggacactcagctcaccaagcgggtaaaaaacgccgctgctaacgttctcagggagacgtggctcatctacaaacataccaggctggtgaagaagccagaccaagcccgggttcggaaacaccagcgtaagttcctccaagccatccatcatggcaggatgctccggagtgtgaagatcgagcaagggaagctgaacgaccaggctaacacgcttaccgacctagccaagacccagaccgtcatgtacgaccttgtatcggagctgcacgctcagcacgaggagctggaggcccgcctggccaccctggaaagccgcttggatgcgctgggtgcctctctacaggccctgcctggcctcatcgcccaagccatacgcccacccccgcctcccctgcctcccaggcccggccccggcccccaagaccaggcagcccggagctccccctgccggtggacgcccgtggccccctcggactgcgggtgacggccctgcccgccaccagacccctaaatcttggccatcgtgtggccgccacctccgggaagccttgtacagtggcgcctcttggagttcaagaagccaacgctgagtcaggctgagtggactgaggcctgccccgcccagactgcccaggcagagggcagggctggaccatgggtgagggcaggggagcccggagcttcctctggtcacctggtcccccgactctccccaggcccccggtgggcatggagcagcccggggaggggtccgtgctggttctgaataaagcaggacccgcctagtggctgcctgtgtgcatggctggaaggcactggtgatgtcccaggaggtagacctccagccctgggtaccaagatgaatgtgggaatcagaaaaacctgttcccatcaccggcctagcctagaatcctagcctagaagccctctctccctctgggctggagctcagtgagggacaactctctagggacacctgtaccagccccacctggcgctgagatccctcagacagcatggcccagccctggccagaagcatcgctccccttcaaccaaccgcgttgatggacacccactgtgtgccaggccccagcggggcccatgggggaggtgacctgggtgaggaaggtcatttgggtttttgtgagatttgtattgagcacctgctgtctacagagaatgtgatgatgtcaatta

SEQ ID NO: 5018 - DNA, 1575 bp, Homo sapiens
cttcgcgctcgggcagggcgcagggactccggctgcggcggccgactccggccgatctcaaagggacaggaaaggcagcagcagccaccctctctcccagtcaagtggtcaccagcaggactgaaggggacagcccctttgcagtggctcggcgaggagacccctgcaccctagggtcagtgcaggagcccagccgctgagccatgccgggccccgggcggcctgcagcgagcccaacccctgcacccaggtagtcatgaacagccacagctacaatggcagcgtggggcggccgctgggcagcgggccgggcgccctgggacgagaccctccggaccctgaggccggccaccccccacaacccccgcacagcccgggcctccaggtggtagtggccaagagtgagccagcccggccctcacccggcagcccccgggggcagccccaggaccaggacgatgacgaggatgatgaggaagatgaggccggcaggcagagagcctcggggaaaccctcaaatgtgggccaccgcctgggccaccggcgggcgctcttcgagaagcggaagcgcctcagcgactatgccctcattttcggcatgtttggcatcgtcgtcatggtgacggagaccgagctgtcctggggggtgtacaccaaggagtctctgtactcattcgcactcaaatgcctcatcagcctctccacggccatcctgctgggtctcgttgtcctctaccatgcccgggagatccagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcggggccctcaacaagatcaccttcaacacgcgcttcgtcatgaagacactcatgaccatctgccccggcaccgtgctgctggtcttcagcatctcctcctggatcatcgcagcctggaccgtgcgcgtctgcgagaggtaccacgacaagcaggaagtgaccagcaacttcctgggggccatgtggctgatttccatcaccttcctctccattggctacggcgacatggtgccccacacctactgcgggaagggtgtgtgcctgctcactggcatcatgggagctggctgtaccgcgctcgtggtggctgtggtggctcggaagctggagctcaccaaggctgagaagcacgtgcacaacttcatgatggacactcagctcaccaagcgggtaaaaaacgccgctgctaacgttctcagggagacgtggctcatctgtaaaatggggtgacagtctatttaaccagaactccctaaaaagggccaggcaactggtaggtgctcaataaatgctccttcccgcctgagggatcacactgg

SEQ ID NO: 5019 - DNA, 3049 bp, Homo sapiens
gtcaggtggaggatccctttccctcccgccctgcttttgctaggggaggggggtgccctgagcctgagtcgcagccagcctgggagctgggccatgttggccgcagatggccccctggtgaaggttcccgttggctttgggaagtagacaacgggtctgcctcacggggctgaggtgggactggaggatttcgagggcagaactctgggaaggaaagaaaggcttaggacccaaccagcattccccctggcactgcgggggcctggccagctcatggcgttccctgagcctgttccccaactgtgaaagggggtgatgatcttcacctcccggcatcctgagcggccaagcaggttgggggcgcctgccccccactaggccaagtggagggggtccctccgtccaatgggcctggccagggccctacgccgcctcagcggcgccctggattcgggagacagccgggcgggcgatgaagaggaggccgggcccgggttgtgccgcaacgggtgggcgccggcaccggtgcagtcacccgtgggccggcgccgcggtcgcttcgtcaagaaagacgggcactgcaacgtgcgtttcgtaaacctgggtggccagggcgcgcgctacctgagcgacctgttcaccacatgcgtggacgtgcgctggcgctggatgtgcctgctcttctcctgctccttcctcgcctcctggctgctcttcggcctggccttctggctcattgcctcgctgcacggcgacctggccgccccgccaccgcccgcgccctgcttctcacacgtggccagcttcctggccgccttcctcttcgcgctggagacgcagacgtccatcggctacggcgtgcgcagcgtcaccgaggagtgcccggccgctgtggccgccgtggtgctgcagtgcattgccggctgcgtgctcgacgccttcgtcgtgggtgctgtcatggccaagatggccaaacccaagaagcgcaacgagacgctggtcttcagcgagaacgccgtcgtggcgctgcgcgaccaccgcctctgcctcatgtggcgcgtcggcaacctgcgccgcagccacctggtcgaggcccacgtgcgtgcccagctgctgcagccccgtgtgaccccagagggtgagtacatcccgctggaccaccaggatgtggatgtgggctttgatggaggcaccgatcgtatcttcctcgtgtcccccatcaccatcgtccatgagatcgactctgccagtcctctgtatgagctaggacgtgccgagctggccagggctgactttgagctggtggtcattctcgaggggatggttgaggccacagccatgaccacacagtgtcgctcgtcctacctccctggtgaactgctctggggccatcgttttgagccagttctcttccagcgtggctcccagtatgaggtcgactatcgccacttccatcgcacttatgaggtcccagggacaccggtctgcagtgctaaggagctggatgaacgggcagagcaggcttcccacagcctcaagtctagtttccccggctctctgactgcattttgttatgagaatgaacttgctctgagctgctgccaggaggaagatgaggacgatgagactgaggaagggaatggggtggaaacagaagatggggctgctagcccccgagttctcacaccaaccctggcgctgaccctgcctccatgatgcaaactgatgtccccttccccgtgtatgcccccttccccaaggtagcaagatggagggatggggctctctcctgggatgggggcaggtgttcctgaataccgacaggcctgctgggtaaatgactaggtggtaaggttctgccatgcctggtgacccaccatggacatactggaccttaattcctctgcttctgtgctccctcctgagaaccctttatgagcctgattcctcagtctcaccagaattctggatcacccaagaggaaaagactggcagttctagattcctctatatggggagacctggattgttgaccagggtgagaagccaatggtatagactgcctctggggaagcaagttggcagttcttgaacagcatcagatatcaagagtttgtaggtctggattcacctaagattcaagggagtgttgcttctcaactcagccaactgagtagcaaatcatttgttctagaccacctaaggagggaaggttatggaatgccccaagtattcaagatcatcttgattgaccaaagaccaaaaaaaaaaaaaagacctgtggttccagaaagctcattagttgagattctgtgagtctaggttgaccacagaggcaagcactggtgagtctaggacagattttacgtggagagttgaactactccagaaactaaagagtaatgtttctagaatgcacaaaacattgttagtctgtgggtttagaaagactgaagtgacagattaagagttcttgatattagataactccaacttctggctgtagagcacccagccaagagaataagcagtgctttgaaaggatccactgggtgggttgtttttttttaaagtgccattctagaatgtccaaagggaatcaggattctgtggctgtagactgatcacagagtcaaggaagcagtggcaattctagatatctgagattttgctggttccagtttgcccaatggagttgagaatctcaatgattctagatgacttcttgtggttctgtaatgccaaaaggaatgaaggctccagggatacagagttgtccattaccaaagcctggaagttctcatcacctccaggtggactgcttggcagtgctaggaggtggactcaggacttcagaagcaacatttctggcctgacctggaaggtgaaggtgaaggtgagaccctgtagggcacagggctaattagtggacaagggaagggggaggcccagggctggtgagtctagaatgctctggaaccctacacctagtgatgtgtgtctatttctttttctttttcttttttttttttttttgagactgagtctc

SEQ ID NO: 5020 - DNA, 3120 bp, Homo sapiens
ggcagaggttgcagtgagctgaggttgcggtgagctgagattgtgccgctgcactccagcctggcgacaaagcacgactccgtctcaaaaaaaaaaagaaaagaaaagaaaaaagttaaaaaaaaaattacccaggagtggtggtgtgcacctgtagtaatcccagctactcaggaggttgagacaggagaatcgcttaaacttgggacgcggagattgcagtaagccaggatcatgccactgcactccagcttgggcgacagagcgagactctgtctccaaaaaaaaaaaaaaaaaaaaaatgcgtatcgttccacctatttgacagatgaggccactaagccccaccagaaagcatgcttggccgatgagctcatccattcctgttgcccctgacgtttctgccggtttcttgtcccagcaggttgggggcgcctgccccccactaggccaagtggagggggtccctccgtccaatgggcctggccagggccctacgccgcctcagcggcgccctggattcgggagacagccgggcgggcgatgaagaggaggccgggcccgggttgtgccgcaacgggtgggcgccggcaccggtgcagtcacccgtgggccggcgccgcggtcgcttcgtcaagaaagacgggcactgcaacgtgcgtttcgtaaacctgggtggccagggcgcgcgctacctgagcgacctgttcaccacatgcgtggacgtgcgctggcgctggatgtgcctgctcttctcctgctccttcctcgcctcctggctgctcttcggcctggccttctggctcattgcctcgctgcacggcgacctggccgccccgccaccgcccgcgccctgcttctcacacgtggccagcttcctggccgccttcctcttcgcgctggagacgcagacgtccatcggctacggcgtgcgcagcgtcaccgaggagtgcccggccgctgtggccgccgtggtgctgcagtgcattgccggctgcgtgctcgacgccttcgtcgtgggtgctgtcatggccaagatggccaaacccaagaagcgcaacgagacgctggtcttcagcgagaacgccgtcgtggcgctgcgcgaccaccgcctctgcctcatgtggcgcgtcggcaacctgcgccgcagccacctggtcgaggcccacgtgcgtgcccagctgctgcagccccgtgtgaccccagagggtgagtacatcccgctggaccaccaggatgtggatgtgggctttgatggaggcaccgatcgtatcttcctcgtgtcccccatcaccatcgtccatgagatcgactctgccagtcctctgtatgagctaggacgtgccgagctggccagggctgactttgagctggtggtcattctcgaggggatggttgaggccacagccatgaccacacagtgtcgctcgtcctacctccctggtgaactgctctggggccatcgttttgagccagttctcttccagcgtggctcccagtatgaggtcgactatcgccacttccatcgcacttatgaggtcccagggacaccggtctgcagtgctaaggagctggatgaacgggcagagcaggcttcccacagcctcaagtctagtttccccggctctctgactgcattttgttatgagaatgaacttgctctgagctgctgccaggaggaagatgaggacgatgagactgaggaagggaatggggtggaaacagaagatggggctgctagcccccgagttctcacaccaaccctggcgctgaccctgcctccatgatgcaaactgatgtccccttccccgtgtatgcccccttccccaaggtagcaagatggagggatggggctctctcctgggatgggggcaggtgttcctgaataccgacaggcctgctgggtaaatgactaggtggtaaggttctgccatgcctggtgacccaccatggacatactggaccttaattcctctgcttctgtgctccctcctgagaaccctttatgagcctgattcctcagtctcaccagaattctggatcacccaagaggaaaagactggcagttctagattcctctatatggggagacctggattgttgaccagggtgagaagccaatggtatagactgcctctggggaagcaagttggcagttcttgaacagcatcagatatcaagagtttgtaggtctggattcacctaagattcaagggagtgttgcttctcaactcagccaactgagtagcaaatcatttgttctagaccacctaaggagggaaggttatggaatgccccaagtattcaagatcatcttgattgaccaaagaccaaaaaaaaaaaaaagacctgtggttccagaaagctcattagttgagattctgtgagtctaggttgaccacagaggcaagcactggtgagtctaggacagattttacgtggagagttgaactactccagaaactaaagagtaatgtttctagaatgcacaaaacattgttagtctgtgggtttagaaagactgaagtgacagattaagagttcttgatattagataactccaacttctggctgtagagcacccagccaagagaataagcagtgctttgaaaggatccactgggtgggttgtttttttttaaagtgccattctagaatgtccaaagggaatcaggattctgtggctgtagactgatcacagagtcaaggaagcagtggcaattctagatatctgagattttgctggttccagtttgcccaatggagttgagaatctcaatgattctagatgacttcttgtggttctgtaatgccaaaaggaatgaaggctccagggatacagagttgtccattaccaaagcctggaagttctcatcacctccaggtggactgcttggcagtgctaggaggtggactcaggacttcagaagcaacatttctggcctgacctggaaggtgaaggtgaaggtgagaccctgtagggcacagggctaattagtggacaagggaagggggaggcccagggctggtgagtctagaatgctctggaaccctacacctagtgatgtgtgtctatttctttttctttttcttttttttttttttttgagactgagtctc

SEQ ID NO: 5021 - DNA, 4170 bp, Homo sapiens
acatttaggagaaacagcggtgtctgcggctcccacccttcggggggcccgtggggggggcggtgtcaggggcatggacgccaccccccaggggtctctgctgccggctactctcctctccacgtgctcccctccaggacccccgacgccgcctaggcgcccagcgacgcgcggcaggtggcagcagctcgggcccccgccgcactccaggcgcccgcagcgctcgccctgacgcggccgccatggcgcaggagaacgcggccttctcgcccgggcaggaggagccgccgcggcgccgcggccgccagcgctacgtggagaaggatggccggtgcaacgtgcagcagggcaacgtgcgcgagacataccgctacctgacggacctgttcaccacgctggtggacctgcagtggcgcctcagcctgttgttcttcgtcctggcctacgcgctcacctggctcttcttcggcgccatctggtggctgatcgcctacggccgcggcgacctggagcacctggaggacaccgcgtggacgccgtgcgtcaacaacctcaacggcttcgtggccgccttcctcttctccatcgagaccgagaccaccatcggctacgggcaccgcgtcatcaccgaccagtgccccgagggcatcgtgctgctgctgctgcaggccatcctgggctccatggtgaacgccttcatggtgggctgcatgttcgtcaagatctcgcagcccaacaagcgcgcagccacgctcgtcttctcctcgcacgccgtggtgtcgctgcgcgacgggcgcctctgcctcatgttccgcgtgggcgacttgcgctcctcacacatagtggaggcctccatccgcgccaagctcatccgctcgcgccagacgctggagggcgagttcatcccgctgcaccagaccgacctcagcgtgggcttcgacacgggagacgaccgcctcttcctcgtctcgccgctggttatcagccacgagatcgacgccgccagccccttctgggaggcgtcgcgccgtgccctcgagagggacgacttcgagatcgtcgttatcctcgagggcatggtggaagccacgggaatgacatgccaagctcggagctcctacctggtagacgaggtgctgtggggccaccgcttcacgtcagtgctgactctggaggacggcttctacgaagtggactatgccagctttcacgagacttttgaggtgcccacaccttcgtgcagtgctcgagagctggcagaggctgccgcccgccttgatgcccatctctactggtccatccccagccggctggatgagaaggtggaggaggagggggcgggggagggggcgggtggggaagctggggctgacaaggagcagaatggctgcctgccacccccagagagtgagtccaaggtgtgaccagcttcctccagacccctgtggcagaccgggggccagacacagatacatggggaactgcatatcggaggtggtggaggaggaggaggaggaggaaggcaaagcccctggaaatgtgctaaagttggaaagtccccgtcccccagaacctcaagtctagaaaccagtatggaagggaggggtcctgatttcagggaaatggagggtggggccgggtgaaaatgccagtctgtgtttgaccttcacatttgttcatgagtggatggatggacagaatgatggacttttgggggttggatgggaagatggtagcagataaagacagctgacagatacatagatggaccagtagacaactggtccactcagggctgccactaacctgtagaacacccctgtgcaaattttaaaaaggaacccttttcctccagacagatacagccccaaaccagggtgcatggcttggggagcagagtataggatggattgcagtccccagtcacctcttctgccagcctccccacatatggcacaactgtctaatgacacggtaggccaagctgaagtgaaggagaaaggagccggaccaagatgggcacatgaggagggtgccctcctagctccaccctcaccaggatgaaggcgtgcaaggggctcagcaaggtgtgaatgaccttagtccgcaagttcagggaagcaggcagagcggggaggtgcctgagctggggcctggagaggggcctgggaaaggaaaaccagggatagctattttcttacagtggagtgagatcttacaggtatcaggcacaggcaggaagagagagagagaggttctggggaggaagggccaggagagagatctagaaagtgggttcactagagctgggaaacagggagcccctaggaaagcagtgtgtccttggggcacagtcattcacatcactgattgggtgccatgtggagtggacattcaaaaacctggttcctgtcctcaaaataaggggcacctgggaaaacagaggaatctacctgtggtgactgaacgagggataattcaaactgacaacctgtgcagtcccgtggagggtaggggagtgtgggtgatcagaaggctggggccagtgtaaggcatagggaatatgtaagtcaggagttagaaatctccagtgtgcgttggaatcacctggagggcttggtaaaacacagatttttgggctccactccaagggtttctgacccaagaggtggggaccaaaaccatgcattcctaagaagtccccaggtcatgctgctgttgctggactgaggaccacactttgagaacctgtgctctaagtgaatacttggaagtcgtttcaggacatggggcatagaaactgaggagtagctgagaggaagatgaagagaagctgagaagaagctgaggatcctcacaggagcagacagagaaatgtgaagggtggggttttatgtgtgggaaagggacccgaagcccaggctgaagagtttaactttgggcccagaaactcaaccatcaatggaaacagggcagtgacaagtggagggggtgtctggaagctgagcaggcccgacagagagatgaagccatcagaaggacttgagggggctcctggggaggtcggggggaggtggagcaggaagagttttaggggcaaaggacagaaccccttgtaggactggaggcaagattgaatgtgggagaaaatcggagagaagcgataggagttagaacatctggatgtgtctgcagcctgctgtcagcccaattgggccagggggtcccaaagacgcatattctcaccccacctccacctgcttcctgatcacatcccagtcaccagcggcagcttcctggatagtgagggagaacaactgcaagttgagagaggcagaggggtggaagggacctgaagctggcctggagaaaagcataggcccaggagagcctgccctgggacagcgcctgtctcccacacagcagcactggcccagcaaggacctcctcccttggccctggccacatcccactcctgccctttcataagccccctggggaaagcactccagtcttctctgttccaggctgggcagatagggtcctatggggcacagccagggtcctatgggcatagccagggccctatgggtcctctggaagcaagaaagggggccatggaagcagcccagacagctggggttcactcagagaggacccaagtcccagtcccttcctttcagtcaaaacacggatatctttgcctcaggtcacagggccactggggccctgtcatcaaagatgagattcctgaagcctggcattgactggtcccctaagaacagatgttgggatggagaatggggattcatttgggtttcagtaaaacaggggggtctggacaagagcgggtgggctacttggtatccacacacacgcactcacacaggagccaacccattgcagctgaacaagcagagaaactcagtctggaaaggcccctcctgcctgctgaagtcactgagaccctgccacacctctcctcgccactgtcaccactcagggcaccactgtacagtgcaacaagtcaggagacctaggtcctactcctgacacttgctaattagctctatgactctgggcaaatcgcatatctgggcctcagtttcctcatctgtaaaaatgacagcaaactcgtaatgctcaataaatgtttaaataacaactgaa

SEQ ID NO: 5022 - DNA, 2303 bp, Homo sapiens
cactgagagctatttgttgctgttaacttcattgtgtacctcttctaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaattttttt

SEQ ID NO: 5023 - DNA, 1563 bp, Homo sapiens
tatagttaaggaggatttggaaatctgatccagtgcagggcgatgtcggtctgggaaggaagactgtgagccctctctccctttttaatatgagaattcgaaagcagtggggaagtgatgttggacctatcacagcattgctaacagacagcctattacagtatttaataaaaacagaaacagcatgcctatcataggctaataaatcctacctcctgcacgctttaaaacagtatgaagcagctttaacggagctccagataactaatttcaagcatggctgtctagcgtgcctgtcactcctattgtccttccaaactctttcagacattttgagcagggagtattaaagctatgagttagaaagggttgtgacattaatggtccacaaaggctttaggcacaagaggtaatgatgattaccggtggctatttggaggactgcaccggatcgctgtcattaaaaattaagcgtggcttttgaggaagatgtgacaactaccggagggcccttccagagaaatgtactgaaaaagtctacgcaatgtctgggatttgctaaacaatacctggaaagcagacaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttg

SEQ ID NO: 5024 - DNA, 2552 bp, Homo sapiens
ctgtgcttcagtgggcttttcactacctttagttagttgcactaggctggttgctgtttaccttgcatggttgactgctctcttctcacattgtgtgccaggaagggcactgcaccttggtataaatgctgctgggcaccgttctgttttctttcttttcttaatcctatccaagtatgcagtacgctcttgggtcgtctcatgagacccaggggcatgttggaaagaactgagagaaagagcaacaaagcggcgagtggtgtgagagggcagcacgcgctgtgggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaatttttttaaaaaaaatcta

SEQ ID NO: 5025 - DNA, 554 bp, Homo sapiens
aaatccctctgtgctgttttgagtgaaacagggaaccagcgtccgccatctgacagttcctccaggtcttttaaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaa

SEQ ID NO: 5026 - DNA, 1455 bp, Homo sapiens
agtgcagggcgatgtcggtctgggaaggaagactgtgagccctctctccctttttaatatgagaattcgaaagcagtggggaagtgatgttggacctatcacagcattgctaacagacagcctattacagtatttaataaaaacagaaacagcatgcctatcataggctaataaatcctacctcctgcacgctttaaaacagtatgaagcagctttaacggagctccagataactaatttcaagcatggctgtctagcgtgcctgtcactcctattgtccttccaaactctttcagacattttgagcagggagtattaaagctatgagttagaaagggttgtgacattaatggtccacaaaggctttaggcacaagaggtaatgatgattaccggtggctatttggaggactgcaccggatcgctgtcattaaaaattaagcgtggcttttgaggaagatgtgacaactaccggaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttg

SEQ ID NO: 5027 - DNA, 599 bp, Homo sapiens
gctgggcaccgttctgttttctttcttttcttaatcctatccaagtatgcagtacgctcttgggtcgtctcatgagacccaggggcatgttggaaagaactgagagaaagagcaacaaagcggcgagtggtgtgagagggcagcacgcgctgtggggcccttccagagaaatgtactgaaaaagtctacgcaatgtctgggatttgctaaacaatacctggaaagcagacaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagc

SEQ ID NO: 5028 - DNA, 651 bp, Homo sapiens
atgtttatatggaccagtggccggacctcttcatcttatagacatgatgaaaaaagaaatatttaccagaaaatcagggaccatgacctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataa

SEQ ID NO: 5029 - DNA, 3017 bp, Homo sapiens
acgctgctgagcccgaggacagacggagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctgcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggggatttcctttagctgggcatggtggcgggcgcctgtaatcccagctactcaggaggctgaagcaagagaatcacttgaaccctaaaggcagaggttgcagtgagccgagatagtgccactgcactacagcccgggcgacagagtgagactccatctcaaaaataaaataaaatt

SEQ ID NO: 5030 - DNA, 3821 bp, Homo sapiens
gcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagggtctccccatgagctggggccccagttcccctctaagggctacagcctcctgggtcctgggagccagaactccatgggggcaggaccttgtgctccagggcacccagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcagaccatcctggctaacacggtgaaaccccacctctactaaaattaaaaaagaaaaaaaatagccgggcgtggtggcaggcgcctgtaatcccagctactggggaggctgaggcaggagaatggcatgaacccgggaggtggaggttgcagggagccgaggccgcaccactgcactccagcctgggtgacagagtgagactccaactcaaaaaaaaaaaaaaaaaagatcttggggaggcagacagccccccagatgggcctctcctaaagtagctacaaactgctgatccaggtgacccaggatggcgtgggtgaagaagctcacgacttttcccagcctcctccagggctccatttaaacagcaagcctggtgcagggtgggagagtctcaggtgtggaggcagcttacaggattgagggggcagtgaagaaagaggtttctgatctacatgagtaccttgctctgagcctcccagctcagaaccctccagcacctcatggctcagcaccaaggcccggggttggtcagaactcttaccatgagcctctgacctggctggagatggaggtatgttctgtggcagacatgtcaggacagtcctccagccctctgctcctgatggttctgtgacattgggtctcttgagggcagtggagtgtcacacagctaataaagtacacatttcatgttgga

SEQ ID NO: 5031 - DNA, 4538 bp, Homo sapiens
ggcagcgatcgatgcggccttcagccgcgggggactaggcaaggaagaaggaaggagagggcagcggggccgcctgcagcaggaggctcggcggggccggcggggcagaggcgagaccgagtatagccagcggctcccagcctcggtggctttgggacagacacgcgaggcgcccgggaggtgccaccacaggtggagatccaagtggaggtgggagcggagctacatcacacgtttattgtgcattgattatgtgccagggaccatgctgccgataaacaccttgcatcatttaattctctgagcctctcctggaaagtatgatgctacccggttccacagacagggaaacaagcccagagagggcgacgaatgcactcaaggacagcagctagtgatgctgatgctgctggtccggggaacacactatgagaacctccggtctaaagtggtgctgccaacacccctaggagggaggagcactgaaacctttgtgagcgagttcccgggccccgacaccgggatccgctggcggcgaagcgacgaggcgctgcgcgtgaacgtgggtggcgtgcggcggcagctgagcgcgcgcgccctggcgcgcttcccgggcacgcggctgggccgcctgcaggccgcggcgtcggaggagcaggcgcggcgcctgtgcgacgactacgacgaggcggcgcgcgaattctacttcgaccggcacccgggcttcttcctgagcctgctgcacttctaccgcactggccacctgcacgtgctcgacgagctgtgcgtcttcgcctttggccaggaggccgactactggggcctaggcgagaacgcgcttgccgcgtgctgccgcgcgcgctacctggagaggcggctgacccagccgcacgcctgggacgaggacagcgacacgccgagcagcgtggacccgtgccccgacgagatctccgacgtgcagcgagaactggcgcgctatggcgcggcgcgctgtggccgcctgcgccgccgcctctggctgaccatggagaacccgggctactcgctgccgagcaagctcttcagctgcgtctccatcagcgtggtgctcgcctccatcgccgccatgtgcatccacagcctgcccgagtaccaggcccgcgaggcggcggccgccgtggctgcggtggccgcgggccgcagcccggaaggcgtgcgcgacgacccggtgctgcgacgcctcgagtacttctgcatcgcctggttcagcttcgaggtgtcgtcgcgcctcctgctggcgcccagtacgcgcaacttcttctgccacccgctcaacctcatcgacattgtgtctgtgctgcccttctatctcacgctgctggctggtgtggcactgggcgaccagggcggcaaggagttcggccacctgggcaaggtggtgcaggtgttccgcctcatgcgcatcttccgcgtactcaagttggcgcgccattccaccgggctgcgctcgctgggagccacgctcaagcacagctaccgtgaggtgggcatcttgctgctgtacctggctgtgggtgtgtcagtgttctctggtgtggcctacacagctgaaaaggaggaggacgtgggctttaacaccatcccagcctgctggtggtggggcacagtgagcatgaccaccgtgggctatggggatgtggtgccagtgacggtggctggcaagctggcagcctcaggctgcatcctagggggcatcctggtggtagcactccccatcaccatcatcttcaacaagttctcccacttctaccggcgccagaaggctctggaggcagccgtgcgcaacagcaaccaccaagagtttgaggacttgctgagcagcattgatggggtgtcggaggcatctctggagacatcccgagaaacctctcaggagggacagtctgcagatctagagagccaggcccccagtgagcctccacaccctcagatgtattaaaaccagggatccgtgaccccctgccatgcccctacagtagagattcctcccctgctaaagttcttcatggtagtgagcctcccaggatcactcatgctgtcctgagaaatgagattcaaaagctgcattccttcctccaaaggcccaggacaggacagtgctaccctagattctgtgagattctgcaagcaactcagaaagctttataaacctgcctccaagccattcatgaagcaggcatgagccagagggaggaagttgaaaggatactaatgattcctgagcacctcctgtacatgaaccaggtcatgtttggccttgtgttggagaaagagaattatccccacttcacagatgaggaaaccaaggctaagagatgagcgatgcctctcccagatgtcacaattagaagtggcagagtcaggtttggaatctgggcttgttggtgtgcctggagcaatgctccatcaactccatctttcttctgccctcatgaagtttgcgtgtgttttttggtgattcatggatccccagagttgatccacaagataagaaatccctttcagagccagggaagggtccagacaggagatttggatataggagctctggatctcagctgtggttcctttctaggagcatccaacaggagtcagcaatcaaagatgagtcctggagggaaggaggatgagtcctgggaggaagtaccatagcattgtacttgcctctttagctggtatgcaagatttgctaagcaataatcttccgaccttcctcccagggctgatgtgagagaaagaaaatctgaagggcccctggcctgagatctagacaacctagctgcgccaagacctgctgtgtaaagtggtccaatccctgcccccaagtccagattccagcccctctgtcaaatggtcagaatctgtgacccagagggcaatgaaagccaaggagagcagaggggtctctaacttaaagccagctcagctctgaaatgttcagagggctgacatatatgaatactggcttctaagaccctcccccaacagtctgaccttggcagttcctttctgcccatcacacagacgtccagccctacattgtccagccctacctagagtacccatccaggcccatgtgtgagagtcctctcccttctggccagctccagccccctcacccttgctgggggcatatctctcatacccacctgctgaatcttctcttcacttgctgagaaagtcagaggaggggatccagtagccctttccacatactgtggctacagcacccagcactgtgctgttgttgtctgactgtggctatctctgtcccatcaccctgagcctcaagatggaagacattgtctgcttgaactctgggcttggtgcagagtaggtatttggtaaatgttgaatagatcaaccaattcctacagcccactgggtgccaagctcagagggggaaaaaaagatagccagagagagacctggccctcaaaaaggtgtgaacaagactgaaaaggaggtccgttcagctccgcctgccctgtccctgcttggttcttgaagtttttacaatatattccttgtaggttcttcactcactcactcaacaaatacccgttggaagagtcttaaactggggcttcatgtgtggcctgcagtcatgtttcggcttagtccaacagtgtttttattatattttaagaatctgaatgcctttgcgtgaggcatgcactctcaggttccccatagtgtctcccccgctgccacccacaaacagacacacatgccgttgtgttatgcccagccactctgatatactggcttctgacttatgggctgcttactagtctcaagagatacagtggtggaaaaatatatccctatactcatgaagcttaccgactagtagggaagatagactctaatgcaataatcacataaatatagcgagctctactaagtacaggtgtgtataatgtatcagggaccatggcccgagaaagtgagaaggctttcctgagcaagtgacaatctaacctgccatccaaatgataaattgctaattaagcaaatgaggttccaggggggagtactccaagcagagagaatggcatgtgtgaaggtgtgtgtcatacacagggcctagtacatagtgggccccctacatacgcatggattctgggtctccagattggaacagaggatggagctaagcagcaaagggcctcccttgaattcaccacacacataccagcccttctgcacactctgctccttacatctaggcccagctgaacccaggttaggggcagatcagaagggctgcgtgtagcacccttatggtcttgcagaacacaccaagaaacccgacggcttccatattttctgaccctacaaacaggtccctaatactgatgtggagaaagctcaagagggaatcatctggcctgagcctaccatgaggctgtttgtggtcctggcagaaaagcaacaactcgctccccttcccatgtatcagtgaaaaccattatgcaaataaagagctgggcccc

SEQ ID NO: 5032 - DNA, 2129 bp, Homo sapiens
agcgatcgatgcggccttcagccgcgggggactaggcaaggaagaaggaaggagagggcagcggggccgcctgcagcaggaggctcggcggggccggcggggcagaggcgagaccgagtatagccagcggctcccagcctcggtggctttgggacagacacgcgaggcgcccgggaggtgccaccacaggtgatgctgatgctgctggtccggggaacacactatgagaacctccggtctaaagtggtgctgccaacacccctaggagggaggagcactgaaacctttgtgagcgagttcccgggccccgacaccgggatccgctggcggcgaagcgacgaggcgctgcgcgtgaacgtgggtggcgtgcggcggcagctgagcgcgcgcgccctggcgcgcttcccgggcacgcggctgggccgcctgcaggccgcggcgtcggaggagcaggcgcggcgcctgtgcgacgactacgacgaggcggcgcgcgaattctacttcgaccggcacccgggcttcttcctgagcctgctgcacttctaccgcactggccacctgcacgtgctcgacgagctgtgcgtcttcgcctttggccaggaggccgactactggggcctaggcgagaacgcgcttgccgcgtgctgccgcgcgcgctacctggagaggcggctgacccagccgcacgcctgggacgaggacagcgacacgccgagcagcgtggacccgtgccccgacgagatctccgacgtgcagcgagaactggcgcgctatggcgcggcgcgctgtggccgcctgcgccgccgcctctggctgaccatggagaacccgggctactcgctgccgagcaagctcttcagctgcgtctccatcagcgtggtgctcgcctccatcgccgccatgtgcatccacagcctgcccgagtaccaggcccgcgaggcggcggccgccgtggctgcggtggccgcgggccgcagcccggaaggcgtgcgcgacgacccggtgctgcgacgcctcgagtacttctgcatcgcctggttcagcttcgaggtgtcgtcgcgcctcctgctggcgcccagtacgcgcaacttcttctgccacccgctcaacctcatcgacattgtgtctgtgctgcccttctatctcacgctgctggctggtgtggcactgggcgaccagggcggcaaggagttcggccacctgggcaaggtggtgcaggtgttccgcctcatgcgcatcttccgcgtactcaagttggcgcgccattccaccgggctgcgctcgctgggagccacgctcaagcacagctaccgtgaggtgggcatcttgctgctgtacctggctgtgggtgtgtcagtgttctctggtgtggcctacacagctgaaaaggaggaggacgtgggctttaacaccatcccagcctgctggtggtggggcacagtgagcatgaccaccgtgggctatggggatgtggtgccagtgacggtggctggcaagctggcagcctcaggctgcatcctagggggcatcctggtggtagcactccccatcaccatcatcttcaacaagttctcccacttctaccggcgccagaaggctctggaggcagccgtgcgcaacagcaaccaccaagagtttgaggacttgctgagcagcattgatggggtgtcggaggcatctctggagacatcccgagaaacctctcaggagggacagtctgcagatctagagagccaggcccccagtgagcctccacaccctcagatgtattaaaaccagggatccgtgaccccctgccatgcccctacagtagagattcctcccctgctaaagttcttcatggtagtgagcctcccaggatcactcatgctgtcctgagaaatgagattcaaaagctgcattccttcctccaaaggcccaggacaggacagtgctaccctagattctgtgagattctgcaagcaactcagaaagctttataaacctgcctccaagccattcatgaagcaggcatgagccagagggaggaagttgaaaggatactaatgattcctgagcacctcctgtacatgaaccaggtcatgtttggccttgtgttggagaaagagaattatccccacttcacagat

SEQ ID NO: 5033 - DNA, 2150 bp, Homo sapiens
gtgctccctgccgaggagatgtgagggattttctcttgggggagaaatcagtggtcgagcgcctgcccagctcaaatgccacccggctcagagggaggcctgcggcccagggatcccggagggagagcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctca

SEQ ID NO: 5034 - DNA, 1959 bp, Homo sapiens
ggcacatagaagagtgagccatcatctggtttccagcgccaagacttctgcaggagagcctccgctgggctttcaagttggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggaacgcagacctctgcaaagccagaagagtaagcggggaaggcagcatctgaacacctcacatgactgcaccttaggaattaacctagtcgcgggcatgactgtacagtggaccagggcatctggtcctgatgacaggcagacaccagctgtaactacattgcacaggatgtattgatattatcattcttgctgacatattctggaagctttcagccccaccaacactgccccacccaggacttctgcagctgagagttcctgtgtcagtagggtctgatatttgtacataggttatacatatatgtgtacatatgtgcctcaatgaacattgcctgtccacctgatcatgggtgtacatagacttcatagagctccacagtcttttgtaaatattgacacaagtaaataagtatataaatatatattactggggatttattttaacatcattctgtgtgatatgaaaaaaataaaatttttgacagaca

SEQ ID NO: 5035 - DNA, 2124 bp, Homo sapiens
ggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtg

SEQ ID NO: 5036 - DNA, 3446 bp, Homo sapiens
ggcgctgcgtggcgcggtgcggctgcgggcggcggccgggagctccgtacgcgccgcccgcgggactgcagagccggctcccggctggccgcccgcaccccgccgccgcccgctgccggggttctgccggcgctggccgtaacctaggaacatggaggccccggtgcccatccggaagggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacgggagtcacctatcaagctaggatttcagatagacacgttgaggccacctcatatcccatacacagtgcaccatatcagtgccatcattccttcctaatgaaatgcacacaacatccaagagatgcactcccctccccaccatcccaccaccttatttgagcccacctgccctttcacagaggaacacaatcatggcttagctttaaatagctggtgtttgttcaaaaggtcatactcatttttgcattgaaaagaacacacagtcctgtgtgttggaattactttctgtgtcacaggctggagtttgtgaattgcagttgccaagtagatgctctggaggcttgtgtttcataacggaaaatgctgcattctgctttttctctgcagtgtcgatgtgagggaagcccgggggagggacagttagtatgaccgaatatgagttgtcaagtttcacatttgttcccttaggcctatggggagaagctaacaaaccaacagacctctaagcctctgatttcaccatttttgcaggctccagggtcacaaaaacatgtctggtttcttactggagtttgcagacatctgctttcccactgatgtggcccagctacactgacactgcagtgaaatttaccagtgatgcaatagagctgcatgggtgtttgttgcatgaatctcaatatttaaaacacaggagataacctattttcctagtagcctacacagtgttaatatttagagtattaataggcttggaatggtcttgaactaggggtttttttcccatcagaaggcaaaaatccctccatcaggggaaaaaaaatagactatttggaatggaactaaaacttctggccccccagcctacctatccctgttcttctaaacaggaacgcagacctctgcaaagccagaagagtaagcggggaaggcagcatctgaacacctcacatgactgcaccttaggaattaacctagtcgcgggcatgactgtacagtggaccagggcatctggtcctgatgacaggcaggtctgtggatccagtgtat

SEQ ID NO: 5037 - DNA, 4237 bp, Homo sapiens
aagcttactggtgaggcaagtgtgcgtctatttccatggcgccctggctcgcggcagcccctggctgggcgaggggtgtgatgtgggagtggggtgggagggggcagcaggcggggcctgccacgtcacttggagagtgtgtgttgggaaggaagggcagagcggagagccgagccgctgcagctgcggcggcggcagcgaagccttgagccgtggggaggtgggtccccgcgctcgggcgccggggcagccccgggccctctgcgaggcctgcggcgcggctcctagggaggaggtggcggctgtggcggccggaaccgcgaccttggccggacccagccccgcggtggacgcagggcggaggccgagccccgccaggagtctttgccgagccggagggaggcgcatctggcgcttcggtaccagcggcagccgggggtccggagcggctggaggagcgcagtgggaactgggaagagctagcccggctggagggcggacctctgcgtccgggagccgggtctcaggcaccgctgggggcgaagccacgcgtcttttcgggcagccaatttcacacgcgcctgtgtgcggttccgggcatcccagtaagctctagcacccgggcgcgggtaacgggaagcgcagaaccaaatccccagcgcccaggtcacctccccagacccagccttgcagggaccagggctttagggctcacggacccaacggccaggtcagaccgcgaaccgggaggagcgcgggccccaccctaaagagggcgcagccgggagctggggagcgggtgccgcgctccagagattgtgtcgtgggcgccgtcctagtggcggggagcgcacctccgagggggcatgagatcggagaaatcccttacgctggcggcgccgggggaggtccgtgggccggagggagagcaacaggatgcgggagacttcccggaggccggcgggggcgggggctgctgtagtagcgagcggctggtgatcaatatctccgggctgcgctttgagacacaattgcgcaccctgtcgctgtttccggacacgctgctcggagaccctggccggcgagtccgcttcttcgaccccctgaggaacgagtacttcttcgaccgcaaccggcccagcttcgacgccatcctctactactaccagtctgggggccgcctgcggaggccggtcaacgtgcccctggacattttcctggaggagatccgcttctaccagctgggggacgaggccctggcggccttccgggaggacgagggctgcctgcccgaaggtggcgaggacgagaagccgctgccctcccagcccttccagcgccaggtgtggctgctctttgagtacccagagagctctgggccggccaggggcatcgccatcgtctccgtgttggtcattctcatctccatagtcatcttttgcctggagaccttaccccagttccgtgtagatggtcgaggtggaaacaatggtggtgtgagtcgagtctccccagtttccagggggagtcaggaggaagaggaggatgaagacgattcctacacatttcatcatggcatcacccctggggaaatggggaccgggggctcctcctcactcagtactcttgggggctccttctttacagaccccttctttctggtggagacgctgtgcattgtctggttcacttttgagctcctggtgcgcttctccgcctgccctagcaagccggccttcttccggaacatcatgaacatcattgacttggtggctatcttcccctacttcatcaccctgggcactgagctggtgcagcagcaggagcagcaaccagccagtggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacgatgacgattcgctttttcccagcatcccggatgccttctggtgggcagtggttacaatgaccacggtaggttacggggacatgtaccccatgactgtggggggaaagatcgtgggctcgctgtgtgccatcgctggggtcctcaccattgccctgcctgtgcccgtcatcgtctccaacttcaactacttctaccaccgggagacggagcaggaggagcaaggccagtatacccacgtcacttgtgggcagcctgcgccggacctgagggcaactgacaacggacttggcaagcctgacttccccgaggctaaccgggaacggagacccagctaccttcctacaccacatcgggcctatgcagagaaaagaatgctcacggaggtctgacccatgcaggcagggcctgcaggaggggagcactgagctaacagtctcttaggcttccttctcatttccactactcactctagcttcagttgacttcttgactctctcccctacacccactacctggcatccaggaccaaatacctggactatcaaccttgttgcttaatccctgcagcattcaaggttaatccatctaagtgacatttttgaaattccagcggtgccacccaatcatgcccagcttctgtcatatgaatgagatatacatttatgtctgaccttccctcaagactgatttttcatgtctgggacttacaatatctcaaggaacagcaatgtcaacaggatggaaaccagccctatctgagtcttcgctccctccttagtgttctttgctttgggtcatgtgcgtttcctagcttcaggctacttggtaactggaagaagctggaggacagaagcagtactcaacttgctgttattccagtgccctgtaacaatcactggtcctcctgcagatgacccttggtagagtctttatttgcatagcctcaaaataggttattcgtttctaaacttggatggaattagagaatacaatcaaactttaccacttggaggacacggggttagtccaggaccaaagaggccaatggatttttcaaagtgtgccccagcacaagaggcactggtgttcggtctacatttagttctccccactctgatcccctgactctccagcttccaggaaggttccttctcagagccaaatactctttgtgcaagtgccttcctgagcagaagaactggagaaagggaaccacagagccaggaggaatgtctgagcagagtcaagcaactggcttgaccacagtctgaagcaaggtgccacttaaacagatactgttttctcaaaggggcagaggaatcgtgttgcagatggcagccttttctccttcattttccccacattttctctggccctctaccttgcttcctgggagtttgatttaggattgctgttgaaggcttcctcaggcaaactccagcttaaagccctagacaggtaaaagcacacattggatggcagcatgggtttcttcccattttatgggcatgaaatatgtggtttagaataaggaacaagcattattcctttgccaacagcctcactctaagaggcttttttgctgagtcaagcaaacacttgcctgctctgccccttggagctgcatttgacctgctctcactggtaaggtgacttggtggcgttcccacttgatttagccattttcttccattgtgagaccactgccatctatccacctgcccacctccccttttgtttctcagtaacattgccatttgttttttgcctttgataaactgtgatgtactgttctgagatcttttgggtgcagttctgaaactgaaaggactgttaacatgtttttaattttatatctatgctttcagactctttgatgataattttttttttaaaaattattctctcgaagagcaacttacgagaggacagccttatgagggtttgcttgagaggcagtgtggcttctgtgactgccagctctaaatctcgatcttgccataactttacagggtaacttgggtccacagtcactctttgtgcctcagtttacccacccattaaatgggaacattactgtcttcccctccctacctcatggggaatgtctgggaagctggggacattgctatgcaaatgtgtgaatcttagtcatggatttgatttttag

SEQ ID NO: 5038 - DNA, 5977 bp, Homo sapiens
aagcttactggtgaggcaagtgtgcgtctatttccatggcgccctggctcgcggcagcccctggctgggcgaggggtgtgatgtgggagtggggtgggagggggcagcaggcggggcctgccacgtcacttggagagtgtgtgttgggaaggaagggcagagcggagagccgagccgctgcagctgcggcggcggcagcgaagccttgagccgtggggaggtgggtccccgcgctcgggcgccggggcagccccgggccctctgcgaggcctgcggcgcggctcctagggaggaggtggcggctgtggcggccggaaccgcgaccttggccggacccagccccgcggtggacgcagggcggaggccgagccccgccaggagtctttgccgagccggagggaggcgcatctggcgcttcggtaccagcggcagccgggggtccggagcggctggaggagcgcagtgggaactgggaagagctagcccggctggagggcggacctctgcgtccgggagccgggtctcaggcaccgctgggggcgaagccacgcgtcttttcgggcagccaatttcacacgcgcctgtgtgcggttccgggcatcccagtaagctctagcacccgggcgcgggtaacgggaagcgcagaaccaaatccccagcgcccaggtcacctccccagacccagccttgcagggaccagggctttagggctcacggacccaacggccaggtcagaccgcgaaccgggaggagcgcgggccccaccctaaagagggcgcagccgggagctggggagcgggtgccgcgctccagagattgtgtcgtgggcgccgtcctagtggcggggagcgcacctccgagggggcatgagatcggagaaatcccttacgctggcggcgccgggggaggtccgtgggccggagggagagcaacaggatgcgggagacttcccggaggccggcgggggcgggggctgctgtagtagcgagcggctggtgatcaatatctccgggctgcgctttgagacacaattgcgcaccctgtcgctgtttccggacacgctgctcggagaccctggccggcgagtccgcttcttcgaccccctgaggaacgagtacttcttcgaccgcaaccggcccagcttcgacgccatcctctactactaccagtctgggggccgcctgcggaggccggtcaacgtgcccctggacattttcctggaggagatccgcttctaccagctgggggacgaggccctggcggccttccgggaggacgagggctgcctgcccgaaggtggcgaggacgagaagccgctgccctcccagcccttccagcgccaggtgtggctgctctttgagtacccagagagctctgggccggccaggggcatcgccatcgtctccgtgttggtcattctcatctccatagtcatcttttgcctggagaccttaccccagttccgtgtagatggtcgaggtggaaacaatggtggtgtgagtcgagtctccccagtttccagggggagtcaggaggaagaggaggatgaagacgattcctacacatttcatcatggcatcacccctggggaaatggggaccgggggctcctcctcactcagtactcttgggggctccttctttacagaccccttctttctggtggagacgctgtgcattgtctggttcacttttgagctcctggtgcgcttctccgcctgccctagcaagccggccttcttccggaacatcatgaacatcattgacttggtggctatcttcccctacttcatcaccctgggcactgagctggtgcagcagcaggagcagcaaccagccagtggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacgatgacgattcgctttttcccagcatcccggatgccttctggtgggcagtggttacaatgaccacggtaggttacggggacatgtaccccatgactgtggggggaaagatcgtgggctcgctgtgtgccatcgctggggtcctcaccattgccctgcctgtgcccgtcatcgtctccaacttcaactacttctaccaccgggagacggagcaggaggagcaaggccagtatacccacgtcacttgtgggcagcctgcgccggacctgagggcaactgacaacggacttggcaagcctgacttccccgaggctaaccgggaacggagacccagctaccttcctacaccacatcgggcctatgcagagaaaagaatgctcacggaggtctgacccatgcaggcagggcctgcaggaggggagcactgagctaacagtctcttaggcttccttctcatttccactactcactctagcttcagttgacttcttgactctctcccctacacccactacctggcatccaggaccaaatacctggactatcaaccttgttgcttaatccctgcagcattcaaggttaatccatctaagtgacatttttgaaattccagcggtgccacccaatcatgcccagcttctgtcatatgaatgagatatacatttatgtctgaccttccctcaagactgatttttcatgtctgggacttacaatatctcaaggaacagcaatgtcaacaggatggaaaccagccctatctgagtcttcgctccctccttagtgttctttgctttgggtcatgtgcgtttcctagcttcaggctacttggtaactggaagaagctggaggacagaagcagtactcaacttgctgttattccagtgccctgtaacaatcactggtcctcctgcagatgacccttggtagagtctttatttgcatagcctcaaaataggttattcgtttctaaacttggatggaattagagaatacaatcaaactttaccacttggaggacacggggttagtccaggaccaaagaggccaatggatttttcaaagtgtgccccagcacaagaggcactggtgttcggtctacatttagttctccccactctgatcccctgactctccagcttccaggaaggttccttctcagagccaaatactctttgtgcaagtgccttcctgagcagaagaactggagaaagggaaccacagagccaggaggaatgtctgagcagagtcaagcaactggcttgaccacagtctgaagcaaggtgccacttaaacagatactgttttctcaaaggggcagaggaatcgtgttgcagatggcagccttttctccttcattttccccacattttctctggccctctaccttgcttcctgggagtttgatttaggattgctgttgaaggcttcctcaggcaaactccagcttaaagccctagacaggtaaaagcacacattggatggcagcatgggtttcttcccattttatgggcatgaaatatgtggtttagaataaggaacaagcattattcctttgccaacagcctcactctaagaggcttttttgctgagtcaagcaaacacttgcctgctctgccccttggagctgcatttgacctgctctcactggtaaggtgacttggtggcgttcccacttgatttagccattttcttccattgtgagaccactgccatctatccacctgcccacctccccttttgtttctcagtaacattgccatttgttttttgcctttgataaactgtgatgtactgttctgagatcttttgggtgcagttctgaaactgaaaggactgttaacatgtttttaattttatatctatgctttcagactctttgatgataattttttttttaaaaattattctctcgaagagcaacttacgagaggacagccttatgagggtttgcttgagaggcagtgtggcttctgtgactgccagctctaaatctcgatcttgccataactttacagggtaacttgggtccacagtcactctttgtgcctcagtttacccacccattaaatgggaacattactgtcttcccctccctacctcatggggaatgtctgggaagctggggacattgctatgcaaatgtgtgaatcttagtcatggatttgatttttagttatccccatacccccataggcaaggccttcccccagagttcctgctttggatccaaagcctgagaataggccattatggaccattggctccctaaatccctccttggcctcttggactgagcccctcagcctttcttcttacccttcagaaaggagagttctctttagatatgttcagggggatccttccatggctggaggtcaccttgactgggggcttggcttctccaaacctgaaacacagtagaagatagagatgtttatgatgcaaaaacctgctctgaggtcagaaagtgctagttttccaaatctctcccattgctgctggctatctggggaaagaagagaaaagcccattccagaggcagaagggaagctcccagccgagggtaaaagttgagacctgtatgcatgtatctctgtatatgtgtatgtaatcaccctcatcaccatccctgagaaaacattttcttttcaagtcagagcacgcctgaaagggtttgtggagagcccagctcaccagggactctggttgccgtagcaaccttccagactgttctctctatcttctgctttgggcatcaagggagaccaggggactacatcttcccagcttctcaaatgggagcacctcccacatcgtggcttaggggctgggagtgccagggcacggatgtgggacttttggaaaatgtggaggaagcagggcctcaaagcttcctgtctggacttttcttcctagtttccccacccagtcattgaagctgcctcatcttactcctgattcttcagaaatttgaatgttaagcaaccagttaaaccaacgtcagtattaattttttcaagctgtcgaggggagcccttagaggggacaacttcttggagtggcggccaagctgggccttaccaggtgtgatcatagtcttaggtatcatggagttcccatctccgcagaggcaggctcttcccagctccacgagaggcggagaattgcaacttcttcctctctgggaacggcctatctagctcctgggaggaatctcaaagatctttcttcttaagacatcgaagaaaaactgagaggctgtagctcgacctagtttctgtgaagaattttgtcaagtgatccctctcggaccctgagcctctttatttggattttgtgccttgagcaccaagagaatatgcactctgggttgcctggacagctggggtggtgattcacaggaagggtccaagccatcactacacctgactcaagccggaaagagctcccagaggacttcctggagctgccagcctcagcctgagatgcgggatattcgtccccaaggagcgaggagggacagctcgccttctttgcaggaaaaatgctggcaggtggtgcaagcaaggacatctatgcatagaattctgacagcagctggaccctcaacttcttcagaagacgagaaccctgcctggcaccgctggcaggcatctggcctgacaccgctctggaggcctcccacaagcagcaaccaagccagaaaaagttgagaccagacccgttgtccctaaagatggggcccagaatgttggggtgaagctgtaggaacagggtgaaagctggtggtgtgagcaaagagaccagctatggggtggtcaggggattccgggaggtgcatgggtatgttgcagacccccccaggacaagggtggctgtggaagaatggcaaataaacacaaggcaaagtctc

SEQ ID NO: 5039 - DNA, 4437 bp, Homo sapiens
tgccaccttctctcctatgcctggctgtggttgcttctcttcctcctgctgccgctgctgctactgccactgcccagtacacaccgccagcccctcggggtgtggtttccccagacctgcccccaacggtgggacccagccttctcccggcgtctcctgccagcttcctgcaaagcccaggagcccccctccctggagacacacccaactccctttcaacaccccacccccctcttaatcccattttggggttaacccccttcctcttatttagtcttcatagatcccctgggtgctctgggattgtgcccaacttcctaacatttgagtcccggcccttggaattccccaggcccctttttcctccctgtagaactcctgagagtgtcgaccaggctttgttggcccgtctagatacccacctcccccagataactctcagcctctcaaaaaataacccagccccctgtctacccctttagataaccccttcccctctccagccctactaggaggctctggcctctcctttcttccccagaactcctgtagagtatagacacccccccgggctattcttggcaactctaggcagtcccaagacacctttcagcctctttacaacctcctggatccacagccacccctcaagatgcaccagctccctttccagatccatgaggggggtctaaccctcttatgcttcccctagaagtcttgagggtgtggacaaccctcctcacctgtctcagcccctctagaacccccacttccaggcactctcagtctctttcaagcacctctggtcccatttctacccctctggatgccccagtctcctctccaccactgcaaaggaattccaggctcttctgccttccctgagactcttgagagtgcagagaattccccacgtgtttcttggcccctctagacgcccccagacacctctcaggcacaggctgactcctttagaatcatctcagtctctctaaaccctccctcagctccttcttggccccatccccacaccccttttctgctcttctccatgtccccaaggcccttctcagtccctcagaacattgcccaggcccctcctaggttctgtaaatgtcccccagactccttcccatctctttagttcttcctcctggttcctcttggcctctctagacacccccagtttccttgtttgggtggctcaaggtgtctccaagcccccaccatcctggagacagccacattctcctaaacgccaccctcactaagtctccctgggcttggggagtggcacgatggcggcaggcctggccacgtggctgccttttgctcgggcagcagcagtgggctggctgcccctggcccagcaacccctgcccccggcaccgggggtgaaggcatctcgaggagatgaggttctggtggtgaacgtgagcggacggcgctttgagacttggaagaatacgctggaccgctacccagacaccttgctgggcagctcggagaaggaattcttctacgatgctgactcaggcgagtacttcttcgatcgcgaccctgacatgttccgccatgtgctgaacttctaccgaacggggcggctgcattgcccacggcaggagtgcatccaggccttcgacgaagagctggctttctacggcctggttcccgagctagtcggtgactgctgccttgaagagtatcgggaccgaaagaaggagaatgccgagcgcctggcagaggatgaggaggcagagcaggccggggacggcccagccctgccagcaggcagctccctgcggcagcggctctggcgggccttcgagaatccacacacgagcaccgcagccctcgttttctactatgtgaccggcttcttcatcgccgtgtcggtcatcgccaatgtggtggagaccatcccatgccgcggctctgcacgcaggtcctcaagggagcagccctgtggcgaacgcttcccacaggcctttttctgcatggacacagcctgtgtactcatattcacaggtgaatacctcctgcggctgtttgccgcccccagccgttgccgcttcctgcggagtgtcatgagcctcatcgacgtggtggccatcctgccctactacattgggcttttggtgcccaagaacgacgatgtctctggcgcctttgtcaccctgcgtgtgttccgggtgtttcgcatcttcaagttctccaggcactcacagggcttgaggattctgggctacacactcaagagctgtgcctctgagctgggctttctcctcttttccctaaccatggccatcatcatctttgccactgtcatgttttatgctgagaagggcacaaacaagaccaactttacaagcatccctgcggccttctggtataccattgtcaccatgaccacgcttggctacggagacatggtgcccagcaccattgctggcaagattttcgggtccatctgctcactcagtggcgtcttggtcattgccctgcctgtgccagtcattgtgtccaactttagccgcatctaccaccagaaccagcgggctgacaagcgccgagcacagcagaaggtgcgcttggcaaggatccgattggcaaagagtggtaccaccaatgccttcctgcagtacaagcagaatgggggccttgaggacagcggcagtggcgaggaacaggctctttgtgtcaggaaccgttctgcctttgaacagcaacatcaccacttgctgcactgtctagagaagacaacgtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcctcagtcagccgtggcagcatgcaggagctggacatgctggcagggctgcgcaggagccatgcccctcagagccgctccagcctcaatgccaagccccatgacagccttgacctgaactgcgacagccgggacttcgtggctgccattatcagcatccctacccctcctgccaacaccccagatgagagccaaccttcctcccctggcggcggtggcagggccggcagcaccctcaggaactccagcctgggtaccccttgcctcttccccgagactgtcaagatctcatccctgtgaggggtaggcctgctgattcagagggtcctcttcatttttgggaactcctttccaaagccatatttttgggaggcagagaggggcaggcttgggcaccccttctgccccccccactgagaactatgcaatggagtttcatgaaatggtccacatagtggggaagtagccaggaaatgagaaacttcctcccaccccagacatttttcctggtgggagctgaagcactgggcttccacaggcccctggcctccttgccctagcacactgggactggccccactctcccagctggactcctgcatgctcctccccttgggctctcagatgaaggcaaagctttgatccgacatctgagctctagcctaagaaggagagttgagatttcctcctccctctggctgggatatggagctttggaggttcagagaagagaaccctcacctctgatctggcctctacgagaggtcctcatctccatctggcccaacaattcccagattctgaagcttggaatgcaaacacaggcttcatgggctgtggcctctgcagcgacctgccatccccaggccttgcctgaggggtcaggctgcctctcccaacacacactcagatagcacaaattctaccatccccttccctggctgctggaaatggaccccgcaaccctgtcctctgctgggcccccagcaaactctagcaatagcagctgctgccgtgtcattatgcaaagcctctgaccagtttgctgcagcatttacatctgccctaatcagaggggccacctctaactcctcctcctcctctcttctcctctggtttgcgtccttcctgggttgggctggagtctggactggctgagataagagcctggcaaccagcaagagctgggctgtatttggagatcatgggctgattccatgttcttgggcaacagtccagaagcatcaggggctccggcctgggatgtttctgaactttgggagttataggagacaggaggaacttctcctcctcctcctcccctacaattccttttcacatattcctttcttctccctcttgggtgaccttccaaaactctgctctcaggctgaaatctggcatcatctcaggttccctgtccccagcactgtccccatggagctggtggctgacaaagatgtagtttccatcagtcaataaaacctgagaggag

SEQ ID NO: 5040 - DNA, 3306 bp, Homo sapiens
ccttgatgtttcccagaacaagatgttttcagcatttttattattattatttttttgtcgatccctgcagaagaaacagagttgggataaaagtatcaaatggaatcatcgaactcatgagctttccaaagatactgtctagggcagatgctgtgatccttctctaagtttccatcactgggattgggtatacagttggtgctcagtatctgttgaaggaatgactgaatgaattgggtttgctcagtttcttcatagaggtacaaaaaaaagttgatttggggtttctaaagcgtagaaaccccaattctggttggaggtccaggatcagactgacaaacaaatactgagcgctgacagtgggctggaactgagtattttgatggcttttactctattcaagtcctcacaacaactctgtgatggtggatggctgcccatgtctcacagttgaggacacgctctgagatgacacatcacagagccagcaatggccaagttggaaagacttttgagcagagtcctgaatgcttaaaatgagtgaaaataccgaaataaggaacagccatcctagggcacagcctgagaaaaggcttagaggctgaagactgcagaggctgtgtttctctggaggagttctgattggttctgcggtcagaacaagagtatgcagtgtgatcttgggcgagtcagttacagaatctccctgatcttcaggggagctctctgtgaacaagttagtaaggttggctctgctctgtctctgtgggaggtgggtggcatggagaaaggcaggagggtttcaaggctcctccctattttgtcatatgtggacagttttcaaggattcccctataggggaatgaaaaggggtcctacctagagcaggtaagacagaggcagccaaaaccaacaaaacactcctcccgggacttgaagcccttcggctggcctgtggtgctgggactctctccccaggaggctgtgttcactgcctgtgacttcctcatgctcccctctgcttggttttcatagatttctagctgactcaggtgcttggtatgtagcttggacaggggcagcagatggtaggggttgagggccaggcccatttctcacttggccacccagcattttacagagcaagaaactgagggactcagaaggtttgagtgcctggccagggtcacagagctagtccggattagatgggatggagtgggggactgaaaggtaggtgggcacttttcctgaccttggcctacctcccctcgctccagctacggagacatggtgcccagcaccattgctggcaagattttcgggtccatctgctcactcagtggcgtcttggtcattgccctgcctgtgccagtcattgtgtccaactttagccgcatctaccaccagaaccagcgggctgacaagcgccgagcacagcagaaggtgcgcttggcaaggatccgattggcaaagagtggtaccaccaatgccttcctgcagtacaagcagaatgggggccttgaggacagcggcagtggcgaggaacaggctctttgtgtcaggaaccgttctgcctttgaacagcaacatcaccacttgctgcactgtctagagaagacaacgtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcctcagtcagccgtggcagcatgcaggagctggacatgctggcagggctgcgcaggagccatgcccctcagagccgctccagcctcaatgccaagccccatgacagccttgacctgaactgcgacagccgggacttcgtggctgccattatcagcatccctacccctcctgccaacaccccagatgagagccaaccttcctcccctggcggcggtggcagggccggcagcaccctcaggaactccagcctgggtaccccttgcctcttccccgagactgtcaagatctcatccctgtgaggggtaggcctgctgattcagagggtcctcttcatttttgggaactcctttccaaagccatatttttgggaggcagagaggggcaggcttgggcaccccttctgccccccccactgagaactatgcaatggagtttcatgaaatggtccacatagtggggaagtagccaggaaatgagaaacttcctcccaccccagacatttttcctggtgggagctgaagcactgggcttccacaggcccctggcctccttgccctagcacactgggactggccccactctcccagctggactcctgcatgctcctccccttgggctctcagatgaaggcaaagctttgatccgacatctgagctctagcctaagaaggagagttgagatttcctcctccctctggctgggatatggagctttggaggttcagagaagagaaccctcacctctgatctggcctctacgagaggtcctcatctccatctggcccaacaattcccagattctgaagcttggaatgcaaacacaggcttcatgggctgtggcctctgcagcgacctgccatccccaggccttgcctgaggggtcaggctgcctctcccaacacacactcagatagcacaaattctaccatccccttccctggctgctggaaatggaccccgcaaccctgtcctctgctgggcccccagcaaactctagcaatagcagctgctgccgtgtcattatgcaaagcctctgaccagtttgctgcagcatttacatctgccctaatcagaggggccacctctaactcctcctcctcctctcttctcctctggtttgcgtccttcctgggttgggctggagtctggactggctgagataagagcctggcaaccagcaagagctgggctgtatttggagatcatgggctgattccatgttcttgggcaacagtccagaagcatcaggggctccggcctgggatgtttctgaactttgggagttataggagacaggaggaacttctcctcctcctcctcccctacaattccttttcacatattcctttcttctccctcttgggtgaccttccaaaactctgctctcaggctgaaatctggcatcatctcaggttccctgtccccagcactgtccccatggagctggtggctgacaaagatgtagtttccatcagtcaataaaacctgagaggagagatgagg

SEQ ID NO: 5041 - DNA, 397 bp, Homo sapiens
gggtcggggcctggatagggttggggtgagccataacggggaggaaggtgctgcccttatcgctctgctccatctactccaggacagcggcagtggcgaggaacaggctctttgtgtcaggaaccgttctgcctttgaacagcaacatcaccacttgctgcactgtctagagaagacaacgtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcctcagtcagccgtggcagcatgcaggagctggacatg

SEQ ID NO: 5042 - DNA, 1401 bp, Homo sapiens
atggagccatggccctgctccccgggcggcggcggcgggacccgcgcccggcacgtcatcatcaacgtgggcggctgccgcgtgcgcctggcatgggccgcgctggcgcgatgccccctcgcgcgcctggagcgcctgcgcgcctgccgcggccacgacgacctgctgcgcgtgtgtgacgactacgacgtgagccgcgacgagttcttcttcgaccgcagcccgtgcgccttccgcgccatcgtggcgcttttgcgcgcagggaagctgcgactgctgcggggcccgtgcgcgctggccttccgcgacgagctggcctactggggcatcgacgaggcgcgcctggagcgctgctgcctgcgccgcctgcgccgccgcgaggaggaggcggccgaggcccgcgcggggccgacggagcgcggggcgcaggggagcccggcgcgcgccctgggacctcgggggcggctgcagcgcggccggcggcgcctgcgcgacgtggtggacaacccgcactcggggctggcgggcaagctcttcgcctgcgtgtccgtgtccttcgtggccgtcacggccgtgggcctctgcctgagcaccatgccggacatccgcgccgaggaggagcggggcgagtgctcccccaagtgccgcagcctgttcgtgctggagaccgtgtgcgtggcctggttctccttcgagttcctgctgcgctccctgcaggccgagagcaagtgcgccttcctgcgcgcgccactcaacatcattgacatcctggcgctcctgccgttctacgtgtcgctgctgctggggctggcggcaggcccgggcgggaccaagctcctggagcgcgcggggctggtgctgcggctgctgcgtgcgctgcgcgtgctctacgtgatgcgcctggcgcgccactcgctggggctgcgttcgctgggcctgaccatgcgccgctgcgcgcgcgagttcgggctgctgctgctgttcctctgcgtggccatggcgctcttcgcgccactggtgcacctggccgagcgcgagctgggcgcgcgccgcgacttctccagcgtgcccgccagctattggtgggccgtcatctccatgaccaccgtgggctacggcgacatggtcccgcgcagcctgcccgggcaggtggtggcgctcagcagcatcctcagcggcatcctgctcatggccttcccggtcacctccatcttccacaccttttcgcgctcctactccgagctcaaggagcagcagcagcgcgcggccagccccgagccggccctgcaggaggacagcacgcactcggccacagccaccgaggacagctcgcagggccccgacagcgcgggcctggccgacgactccgcggatgcgctgtgggtgcgggcagggcgctga

SEQ ID NO: 5043 - DNA, 3923 bp, Homo sapiens
gtgggccgctcccctctgggaggagggctgcccagaggggtgcgggtgtcgctagcggcccctccccgtgtggggccacgtggcgggtgcgggccgagcccgaggggaagaacctggcccgtggggaggtgggggggaccgaaacggcgctgagccgagccgagagctacggggttcggagcagaggcagcggcagcggcagcggcagtaagagggaggggaggaggcaggagggcgcatggggcgccccggcccctccgacagcgcgccccctccggcccggccgcgctgaaagctccccagcgccgcgccttgaacccacgccccggggccatgccggtcatgaaggggttgctggccccgcaaaacaccttcctggacaccatcgccacccgttttgacggaacgcacagcaacttcctgctggccaacgcacagggcacacggggctttcccatcgtctactgctccgacggcttctgcgagctcacaggctacggtcgcaccgaggtcatgcagaagacctgcagctgccgtttcctctacggcccagagaccagtgagccagccctgcagcgtctgcacaaagccctggagggccaccaggagcaccgggctgaaatctgcttctaccgcaaggatggctcagccttttggtgcctcctggacatgatgcccatcaagaatgagatgggggaggtcgtgctgttcctcttttccttcaaggatatcactcagagtggaagcccaggacttggcccccaaggaggccgcggggacagtaatcacgaaaactcccttggtagaaggggagccacctggaaatttcggtctgccagaagacggagccgtactgtcctacaccgactgaccggccactttggccgccggggccagggaggcatgaaggccaataataacgtgtttgagccaaagccatcagtgcccgagtacaaggtggcctccgtgggggggtctcgctgcctcctcctccactacagcgtctccaaggccatctgggacggccttatcctccttgccaccttctacgttgcggtcaccgtcccctacaatgtctgtttctcgggtgacgatgacacccccatcacttcgcgacacacccttgtcagcgacatcgccgtggaaatgctcttcatcctagatatcatcctgaacttccgcaccacctatgtgtcccagtccggccaggtaatctctgctcctcgttccattggcctccactacctggccacctggttcttcatcgaccttattgctgctctgccctttgacctgctttacatcttcaacatcaccgtgacctcgctggtgcacctactgaagacagtgcggctgttgcggctgctgcggctgctgcagaagctggagcggtactctcagtgcagtgctgtggtgctcacgctgctcatgtcggtctttgcgctccttgcccactggatggcctgcatctggtatgtcatcgggcgccgggagatggaggccaatgacccgctgctctgggacattggctggttgcatgagttgggcaagcgtctggaggtgccctatgtcaatggctcggtgggcggcccatcacggcgcagcgcctacatcgcggcactgtacttcactctaagcagcctcaccagtgtgggctttggcaacgtgtgtgccaacaccgacgcggagaagatcttctccatctgcacgatgctcataggcgccctgatgcacgctgtggtgttcgggaacgtgacagccatcatccagcgcatgtactcgcgccgctcgctctaccacagccgcatgaaggacctcaaggacttcatccgtgtgcaccgcctgccgcggccgctcaagcagcgcatgctcgaatacttccagaccacgtgggccgtcaacagcggcatcgacgccaacgagttactgcgtgacttcccagacgagctgagagctgacattgctatgcacctgaatcgggagatcctgcagctgccgttgttcggggcagcgagcaggggctgcctgcgggccctatcgctgcacatcaagacctcgttctgcgctccgggcgagtacctgttgcgccgtggggatgccctgcaggcacattactatgtctgctccggctcgcttgaggtgctccgagacaacatggtgctggccatcctggggaagggggacctgattggagcagatatccctgagccggggcaggagcctgggttgggagcagacccaaacttcgtgctaaagaccagtgctgatgtgaaagctctgacctactgtggcctgcagcagctgagcagccgagggctggctgaggtcctgaggctctatcctgagtatggggctgccttccgggctggcctgccccgggacctcaccttcaacctgcgccagggctctgacaccagtggcctcagccgcttttcccgatcccctcgcctctcccagccccgctcagaaagcctcggctcctcctcagacaagacgctgccatccatcacagaggccgagagtggcgcggagcctgggggtggtcccaggccccgacggcccctcctgctgcccaacctcagcccagcacggcctcggggctccctggtcagccttttgggcgaggagctgcccccattctcagcccttgtctcctctccttccttatccccatccctgtcccctgccctggctggccagggccacagtgcctcccctcacggcccccccaggtgctctgctgcctggaagccccctcagcttctcattcccccactgggaacctttggacctccggacctcagtccccggatagtggatggcattgaggactctggcagcacagctgaggccccttcattccgattcagcaggaggcctgaactgccaaggccccgctcccaggcgccccctacagggaccaggcccagcccagaattggccagtgaggctgaggaggtgaaggaaaaggtttgccggctgaaccaggagatctctcgtctcaatcaggaggtgtctcagcttagccgggagctgcggcacatcatgggcctgctgcaggccaggctgggtcccccaggccacccagcaggctccgcttggaccccagaccctccttgtccacagctgaggccaccatgcctctctccttgtgcgtccagaccaccacccagcctccaggatactacgcttgctgaagttcactgcccagccagtgtggggaccatggagacagggactgcgctcctggacttgagaccttccatattgcccccctacccctcagagcctgaccctctgggaccctctccagtgccagaggcctcacccccaaccccaagcctcttgaggcacagtttccagtccaggtcagacacgttccactgaccctggcccagggcccaggcctgtctggggtgggcgctgccgctcaccactcagggaggacctgggccccttggcttcctgccttggggtcagcagccaccagctggcctggttggctctggatttctggactttttaatgaagcgtggttacctctgacgctattcccttttccaagccttccccaacctccccctctgtgaggggagccacctgagggctgtggaacccagcaggcatgagatgaaccgcagtgcccattgggctgggcagatgagatcctactttctccccaggacctggaggcaggctgtctctcaaggtggtctcttctgctgctagcaactcaaaaatcccaacagcactccctatcctttccctgaccccagaccgctgccaagcctgttctcccccattacaacatggtctcactcagggcctggactgctccaaaactcgcccaggtctccagctctcctctaccacccaacaccctgggctcacttttggataggaaataaactctttatttttgt

SEQ ID NO: 5044 - DNA, 3402 bp, Homo sapiens
acgctgctgagcccgaggacagacggagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagggtctccccatgagctggggccccagttcccctctaagggctacagcctcctgggtcctgggagccagaactccatgggggcaggaccttgtgctccagggcacccagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcagaccatcctggctaacacggtgaaaccccacctctactaaaattaaaaaagaaaaaaaatagccgggcgtggtggcaggcgcctgtaatcccagctactggggaggctgaggcaggagaatggcatgaacccgggaggtggaggttgcagggagccgaggccgcaccactgcactccagcctgggtgacagagtgagactccaactc

SEQ ID NO: 5045 - DNA, 3135 bp, Homo sapiens
acgctgctgagcccgaggacagacggagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctgcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcagaccatcctggctaacacggtgaaaccccacctctactaaaattaaaaaagaaaaaaaatagccgggcgtggtggcaggcgcctgtaatcccagctactggggaggctgaggcaggagaatggcatgaacccgggaggtggaggttgcagggagccgaggccgcaccactgcactccagcctgggtgacagagtgagactccaactc

SEQ ID NO: 5046 - DNA, 5137 bp, Homo sapiens
gggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccgggtcccccttccctgccgtcatcaggttccccttctcccttcttggcactttcctttcgaaccatccttctggacaaactttgatggagaatttcacaccacgctggaaaaatgccggttatgaaaggattactggcgccgcaaaacaccttcctggacaccatcgccacccgttttgacggaacacatagcaacttcatccttgccaatgcccaggtggctaagggtttccccatagtctactgttccgatggcttctgcgagcttgctggatttgcccgaactgaagtcatgcagaagagttgtagctgcaagttcttatttggggttgaaaccaatgagcaactgatgcttcaaatagaaaagtcactggaggagaaaacagaattcaaaggagaaattatgttctacaagaaaaacgggtctccattttggtgcctactggatattgttcccataaagaatgaaaaaggagatgtagtactttttctggcctcgttcaaagatataacagatacaaaagtgaagattactccagaagataaaaaagaagacaaagtcaaaggaagatcaagagcagggacccactttgactcagcccggagacggagtcgagcagtcctttatcacatctctgggcacctgcaaagaagagaaaagaacaaattgaaaataaataacaatgtttttgtagataaaccagcatttccggagtataaagtttctgatgcaaaaaagtccaaattcatacttctgcattttagcacttttaaagctggctgggactggcttattttgttggcaacgttttatgttgctgtgactgtaccttacaacgtttgctttattggcaatgacgacctgtccacaactcggagcacaaccgtcagtgacattgcagtggagattctttttattatagatattattttaaatttccgaacaacttatgtcagcaagtctggccaagttatctttgaagcaagatcaatttgcatccactatgtcacaacctggttcatcattgatttaatcgctgccctgccttttgatcttctgtatgctttcaacgtcacagtggtgtctctcgtgcatcttctaaagacagtgcgcctcttgcgtcttttgcgtctgctgcagaagttagaccgctattcccaacacagtactatcgtcctgactctgctcatgtccatgtttgcactccttgcacactggatggcgtgtatctggtacgtcattggaaaaatggagagggaagacaacagccttctgaagtgggaagttggttggcttcatgagttgggaaagagactggaatctccatactatggcaacaataccttggggggcccgtcgatccgaagtgcctatattgccgctctgtacttcacgctgagcagcctcaccagcgtgggttttgggaacgtctctgctaatacagatgcagaaaagatcttctccatctgcaccatgctgattggtgccttgatgcacgccttggtgtttggaaacgtgacagcaatcatacagaggatgtactccagatggtccctctatcacactagaactaaggatctgaaagatttcatccgtgtccatcacttgccccaacaactcaagcagaggatgctcgaatattttcaaacaacctggtcagtcaacaatggaatagattcaaatgagcttttgaaagactttccagatgaactgcgttctgacatcactatgcacttgaacaaggagatcttacagttgtccctttttgaatgtgccagccggggctgcctcaggtctctgtctctacacatcaaaacctctttctgtgctccgggggagtatctgctgcgtcaaggggatgctttgcaggccatctactttgtatgctcgggctccatggaagttcttaaagacagcatggtgctggctattcttgggaaaggggatttaattggagcaaatctatcaattaaggaccaagtgatcaagaccaatgcagatgtaaaggctttaacctactgtgatctccagtgtatcatcctcaaaggactctttgaagtgctagacctttacccagaatatgctcacaaattcgtggaagacattcagcatgacctcacatacaacctccgagaaggtcatgagagtgatgtgatatcaagactatcaaacaaatctatggtctcacagtcagagcccaagggaaatggcaacatcaacaagcgactcccatccattgtggaagatgaggaagaggaggaggagggggaggaagaggaggcagtctccctctctcccatctgcacaaggggatcttcttcgcgcaacaagaaggttggaagcaataaagcctacctgggcttaagcttaaagcaactggcctcgggaacggtgccctttcactcgcctatcagagtctccaggtcaaattcccccaaaaccaagcaggaaattgacccccccaaccataataaaaggaaagagaagaacttgaaattgcaactttcaactttgaataatgctggacccccagacctcagtccaaggattgttgatggaattgaagatggaaacagcagtgaagaaagtcagacttttgattttggctctgaacgaatcagatcagagcccagaatttctcctcctcttggagatccagagattggagctgctgttctcttcatcaaagcagaggagaccaagcagcagataaacaaactcaacagtgaggtaacaacattgactcaggaagtttctcagttgggtaaagacatgagaaatgtgatccagcttctggaaaacgttctgtcacctcagcagccatcacggttttgctctttgcacagcacctctgtgtgtccctccagggagagcttacagaccagaacgagctggagtgcacaccagccttgcctacacttgcaaacaggcggggctgcttatacccaagcacaactttgtagcagtaatatcacctcagacatttggagtgtggatccctcctctgtggggagcagcccccaacgaactggagctcatgagcaaaatcctgcagacagtgaactttatcattctccaagccttgattattcaccttcccactaccaggttgtccaagaaggtcatttgcaatttttaaggtgcatctctccacattcagattctacgttgacgcctctgcagtccatttcagcaactctctcatcttctgtctgctcctcttcggaaacatctttgcacctagttctcccaagcagatcagaggagggcagcttcagtcagggaactgtgagttccttcagtctggaaaacttaccaggatcttggaaccaggaaggaatggcatcagcttctacaaaacctttggagaaccttccactggaagttgtcacaagcacagcagaagtgaaagataacaaagccataaatgtatgatattagtgcccatgatgcagcagctaatttcaaacctaccactgcatgacagttttagtttgcctttttgcctctggtgggcatgaagactgagcaaagctgggaatcctgcagaaaagagtgtgaggagccagggaaaggcagaaccacctccatgctgtagcaaacaatttctagatactagaagcataatagaaacatttttctgtacaggtattaaactactggtctgtttgacagactttggtaacaatccaaagaccctgagggtctgagcagctagaagtcctagacaaagaacttgtggatgacttttgtcccatgtggcttttgtgaagtatggcaaaggtttttcatgagtgcctgattgttattcctgaacaatatccatagcactgttggcctcaggagtgcacagctcctgctgatgtatttttctttttgtgaaggcaaagggacaattatcactgcatgtcatctcctagacaatcagtcaaatagagctggtggccagtggttagctattcgcacgttatttgccatgtaaatgaaaacgtctttatttatcaaaaaaacacagaggctatttttatatccttggtatgaaatatgtatttaaactatttaaatatttataaagaaatgaatgttttcttttcattttggtaaaaaaaaagcttgctgttttaacaagaaatgcactactgttgtgtatagtagatcaaaaattatttattactaagaggatgtagtttccaaaggaatcccccattttttctgcatgcagtttgcaacaaatgtattctcatgcttctggattataaaagaaaagtgaagtcatattttgttaatgaaataaaaacatggactgagtgtcaactacatgagctttggcatggggatagagaggctccatctaggctctgccaactcatgtcaatgacatgatttaaggtcgttgtgccagcagaaatgtctctcctctaggtatcgtattttgttgctcaagaatccaaaatgggtctgtggacatagggcaatttggggctcaaagtgagggagaaaacctgggtgtgtcctttcccagtgcttttcttttacaagaggtagtagactagtggaaatccccaaatggagccaagacttctgagctataacttgtgggagtaataccagcttgcaatgggtcagcactttaccttttttctttaaggctcccaacaatgctatacagcgcagttgtttccattcctatttttaataaatctcaggggaagcctcagagattacacagttaggatgctgacacagtctagaatccataatgctccctacatctcacactaacaggcaaattcagatgctgggattggcaatgatttaagcaccttcactaaagtcttattttatgttttagaacagttacagtctaattgtcttggacattttgggaagatatattgggttcacattctggagttctctttattttccaccacaaaaaataatctgagaattgtatcattaaaagtatctaaacacaccaa

SEQ ID NO: 5047 - DNA, 1006 bp, Homo sapiens
caagttatctttgaagcaagatcaatttgcatccactatgtcacaacctggttcatcattgatttaatcgctgccctgccttttgatcttctgtatgctttcaacgtcacagtggtgtctctcgtgcatcttctaaagacagtgcgcctcttgcgtcttttgcgtctgctgcagaagttagaccgctattcccaacacagtactatcgtcctgactctgctcatgtccatgtttgcactccttgcacactggatggcgtgtatctggtacgtcattggaaaaatggagagggaagacaacagccttctgaagtgggaagttggttggcttcatgagttgggaaagagactggaatctccatactatggcaacaataccttggggggcccgtcgatccgaagtgcctatattgccgctctgtacttcacgctgagcagcctcaccagcgtgggttttgggaacgtctctgctaatacagatgcagaaaagatcttctccatctgcaccatgctgattggtgtttcacagttccaggtgtgtccaaggccttcttggattatctgctggtttagaaaccatttcggtttcattctgctaatgactaccttgatgcacgccttggtgtttggaaacgtgacagcaatcatacagaggatgtactccagatggtccctctatcacactagaactaaggatctgaaagatttcatccgtgtccatcacttgccccaacaactcaagcagaggatgctcgaatattttcaaacaacctgcttttgaaagactttccagatgaactgcgttctgacatcactatgcacttgaacaaggagatcttacagttgtccctttttgaatgtgccagccggggctgcctcaggtctctgtctctacacatcaaaacctctttctgtgctccgggggagtatctgctgcgtcaaggggatgctttgcaggccatctactttgtatgctcgggctccatggaagttcttaaagacagcat

SEQ ID NO: 5048 - DNA, 2272 bp, Homo sapiens
ggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgctgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctg

SEQ ID NO: 5049 - DNA, 2489 bp, Homo sapiens
ggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgctgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctg

SEQ ID NO: 5050 - DNA, 2555 bp, Homo sapiens
ggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgctgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctga

SEQ ID NO: 5051 - DNA, 1247 bp, Homo sapiens
ggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgctgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacgg

SEQ ID NO: 5052 - DNA, 2153 bp, Homo sapiens
aagctgggccctggcggcggatctggacgtggtgagccggaccgggggcaggtggcaaacttcacggctgggggtcggggctcctgggcttccctgccacatccttccagccctctcctccggccgctggactgtcccggctcctgcgccctccttgtggcgcgatatcgtgggacgaggctccgggccgggactgggtggccctcgggaatccgcagccagtggccccccacctcaaaggcgaccagcgcggcctctcgagctggcctggccaggagttgccctgccccggccgaccggccccttggcatctgatggcttcgtttttcccgggccggccgggcgaggggccctcgcggcgctggccccagcagctgtcctatcattatccctccaaacaggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaaaagataaccgag

SEQ ID NO: 5053 - DNA, 1805 bp, Homo sapiens
agaagctgggccctggcggcggatctggacgtggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaaaagataaccgaggaaacggtacctccccatga

SEQ ID NO: 5054 - DNA, 1548 bp, Homo sapiens
gcggcggatctggacgtggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaaaagataaccgaggaaacggtacctccccatga

SEQ ID NO: 5055 - DNA, 1830 bp, Homo sapiens
aggggaggggcggagcgaggcgggtccggggcctggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaacaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttgaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacccgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaa

SEQ ID NO: 5056 - DNA, 1031 bp, Homo sapiens
agagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttgaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagt

SEQ ID NO: 5057 - DNA, 4889 bp, Homo sapiens
cctctgcttccgccgccgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcacacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacaaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcaggaaggcaagaggtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgatttttgtttgtttccttttaagtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaata

SEQ ID NO: 5058 - DNA, 4737 bp, Homo sapiens
tgtaggaatcttctgcggcttgtccatagtgtgaataaaaactaaatcacatctataattctactgaactggtcacacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacaaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcaggaaggcaagaggtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgatttttgtttgtttccttttaagtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttct

SEQ ID NO: 5059 - DNA, 2140 bp, Homo sapiens
agctctgagctcgcggaggcgtggccggtgcgcggggcccgcggcgcgcggggatgggggtctcggtggatgtgcaccaggtgtacaagtaccccttcgagcaggtggtcgccagctttctccgaaagtaccccaaccccatggataaaaatgtcatctcagtaaaaatcatggaggaaaaaagagatgaatcaacaggggtcatctacagaaagaggattgcaatctgtcagaacgtggttccagaaattttaaggaagtccttaagcactctggtgattctttgttggaaaaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagagagctgtatccatgtctacttatttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagaaccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgtgatttggtcctctggaaaaaaaaaaatgaaatgaagagtgggaaggcagtttcttttctgctaattcgttctgtgatggtgagcaagcaaatcattaacctctctgttttttattgggcaaatggggataatcaggcacaggtctttccgccaatgcgttatgatgattaaagaaggtaattttgtgcagggttttaagtcaacagacagacctgggtttgaatccaagtgctggcacctacttgctcagtgatcatgaacacaattttaaatctttctgaatctcatttaaaaaaatttgtgaaacaagatgatagaattaattttgtgagattgttggactgatttgagatcatgcctatgaagtacctagcacactgcctagtacatagtagaagtccaggaaatggaagccattattatgtaaaacattttgcaaaggtactttttaactgtaacgtaaagtggtactactgtttgaaacttagatggcagtagtttgcatttctcgtgatcagaagccaaaatataaatacatactacctaaaaaatcttgaagagaggtaataatttgaaattcatcttcttaagataaaaatcagggcagggtgtggtggcttatgcctgtaatcccagtactttgggaggccgaggcgggtggatcacaaggtcaggagttcgagaccagcctggccaatatggtgaaaccccgtctctactaaaaatacaaaaaaattagctgggcgtggtggcgcatgcctgtaatcctagctacttgggagtctgaggcaggagaattgcttgaactcaggaggtgaaggttgcagtaagctgagattgtgccactgcaccccagcctgggtgacagagcaagactccatcac

SEQ ID NO: 5060 - DNA, 2104 bp, Homo sapiens
agctctgagctcgcggaggcgtggccggtgcgcggggcccgcggcgcgcggggatgggggtctcggtggatgtgcaccaggtgtacaagtaccccttcgagcaggtggtcgccagctttctccgaaagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagagagctgtatccatgtctacttatttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagaaccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgtgatttggtcctctggaaaaaaaaaaatgaaatgaagagtgggaaggcagtttcttttctgctaattcgttctgtgatggtgagcaagcaaatcattaacctctctgttttttattgggcaaatggggataatcaggcacaggtctttccgccaatgcgttatgatgattaaagaaggtaattttgtgcagggttttaagtcaacagacagacctgggtttgaatccaagtgctggcacctacttgctcagtgatcatgaacacaattttaaatctttctgaatctcatttaaaaaaatttgtgaaacaagatgatagaattaattttgtgagattgttggactgatttgagatcatgcctatgaagtacctagcacactgcctagtacatagtagaagtccaggaaatggaagccattattatgtaaaacattttgcaaaggtactttttaactgtaacgtaaagtggtactactgtttgaaacttagatggcagtagtttgcatttctcgtgatcagaagccaaaatataaatacatactacctaaaaaatcttgaagagaggtaataatttgaaattcatcttcttaagataaaaatcagggcagggtgtggtggcttatgcctgtaatcccagtactttgggaggccgaggcgggtggatcacaaggtcaggagttcgagaccagcctggccaatatggtgaaaccccgtctctactaaaaatacaaaaaaattagctgggcgtggtggcgcatgcctgtaatcctagctacttgggagtctgaggcaggagaattgcttgaactcaggaggtgaaggttgcagtaagctgagattgtgccactgcaccccagcctgggtgacagagcaagactccatcac

SEQ ID NO: 5061 - DNA, 1102 bp, Homo sapiens
gggcgcctccgggcctctgcggagccctgggcagctctgagctcgcggaggcgtggccggtgcgcggggcccgcggcgcgcggggatgggggtctcggtggatgtgcaccaggtgtacaagtaccccttcgagcaggtggtcgccagctttctccgaaaggtttccacgctttgagaaggactgaatgagatcatgcgcatggcagcttctctaggatagcaccctgcgtgaacacagtagctgctcagttaagtctttgatgggtgtgatcctgattcagcttgatcaattctgcagtcatactggattgtgtttgaaaaggtgtccagaaaaacctggccatctgcctcctgtcttcccagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagagagctgtatccatgtctacttatttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaa

SEQ ID NO: 5062 - DNA, 1964 bp, Homo sapiens
agtggccggtgtgagcgcagagccgggccctgggcagcagcggcagcgcggtaggacctcgcgcagcgtccgcgggctccggggcgggggcgccagcggcgaagccccctccccggggaggcgggacctgggggagctcccgagccggggagcggcggcggccgggaacgatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccagaaaatattttcagatggaaaataactaagaggacactgggtggagtgaacaacagtctccaaaacctgtatttgcttgtttgagaactttagctctggagtcagactgcttgggttcaagacccacatcaaccactttctagttacgtgggctaaaatcacttccacggtgaatcagagaagggattgtaccactcgtcacgtgtgttgggaaagaagaaagggtgagaaaccctggcctaaacaatccatcccacagatcctcaggcattcctttgtgtacttggtttttcaccactgagctttaaataagaatggaaatacaagggaaaacctgcgttgtaaacatgaggatttgggaacagatctaggacatgccactgaattgaagaccacccatcttccaggcagggccagaattacagaaaacaattctggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattagaatcaggaacgaagattcagggaatgtctgtcacatcttatggcatcccacctggacagaatatccgatttgaagattgtgattgacttccgtaaaactgtacaactctccatttggcagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacaggtacctcctgctgaggaaaagttaggttccaggctgcaagttaccacaatccaagataaccaaacaagtctgaatgttgaaaagctgttcaatgtactcagcagaaatcctaaacactcaattcttcttttggctttacattttgatgatgttacatgtgtaacttgcctgaatgagaaatgaaaggaacagaaccaaaaggatcttctggaggatggttatgtggagcagaaagtgagtctacattcttatctgaggatgctctctcctcgagcctatctgcaaaaataagatgaaacg

SEQ ID NO: 5063 - DNA, 1055 bp, Homo sapiens
gctggcggcagtggccggtgtgagcgcagagccgggccctgggcagcagcggcagcgcggtaggacctcgcgcagcgtccgcgggctccggggcgggggcgccagcggcgaagccccctccccggggaggcgggacctgggggagctcccgagccggggagcggcggcggccgggaacgatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccagaaaatattttcagatggaaaataactaagaggacactgggtggagtgaacaacagtctccaaaacctgtatttgcttgtttga

SEQ ID NO: 5064 - DNA, 2288 bp, Homo sapiens
gatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccaggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattagaatcaggaacgaagattcagggaatgtctgtcacatcttatggcatcccacctggacagaatatccgatttgaagattgtgattgacttccgtaaaactgtacaactctccatttggcaggagttaatgccgagaatccatcagaagtatctactgtttagaaggaaatggagcagcaccaaatgggtctaattcgactggttgggactgttgggactgatgtggagtgatgctttgcaccacaagttctgtaaagggcacggcaccaaaatcatccattttcaatacatctgcactatggaatgacccatgtagtgaattttgtcttggccgccctggcaggacagtattgtgatcagcacggatgtcgctcaggccctgatgtggagggtgccatgacaggtctggagaatggaagggcttggcaccgaaggggtccaacaggctctcctcaggttgtaagacattccccctatctttcccatcagtcagtgcaacactaatgttctccttggagtctgagatggttaaaaattcattgctactttgagagtctcggcggcccacttttttgtgcctgcgagccctctctggagtgcgataggtaggcttcaaagtcttctttgtgctagttggcgtgccatgatgccgcttcccattacttttggacatatcctgctttgtgcgcctttggcgagaggacagtttctgtaagctgcgctgtttgactttttgctgctggctccccgttatttcatcaaagggcacaagcccaaaaaggtcctcattgctttcacttttacttgttgatgtgaggaagggctgaaatggagtggagccaaatacatctacacttttgggataaccagggatagtatgtgcctcaggccccactgcatggcattcttgtacattcaccttcttgctaaaaggcgcctttgtgaatacatcaaattcctcctgctccagtcctgcagcaggaaacctgtgttgagggaggttcttttcattcttttcttgctggggctgttgagcacgcactgcaaagaaggggacagcgccaaatacatcaaactcctgtttgggagtctccactgcaacatcagaggataattgggctgaggtgaggagtattgtattaagatcttgggttggtccactgccagatctgtctctgtagacagagctcatgtcactgtactttgctttagcctgctcataatcagaatcagagctatgtttctcctcttcttcctcatcttcagaatccatgaggagaggcctatgacccagattttctggttcagtatcatcatcattaaaatctccttgttccccctgaagaa

SEQ ID NO: 5065 - DNA, 9811 bp, Homo sapiens
agaggaggctgcgacgctgccgggtccgccgcggcgctggcggcagtggccggtgtgagcgcagagccgggccctgggcagcagcggcagcgcggtaggacctcgcgcagcgtccgcgggctccggggcgggggcgccagcggcgaagccccctccccggggaggcgggacctgggggagctcccgagccggggagcggcggcggccgggaacgatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccaggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattaggtatggccacctggtgaattcagttgttaagcaatatataatggggaattgtataccccactatttctaagattcccattagttttccctttttcctttttaatatgagtaatgctttataaaaatgggaaaaaaagtatacttaaggatctgtagtaataactgctttacaaaatccttaaaactactaatttgctgcttgtacagaaagtgaaaattagttggcaatcataagaaacatctgaataacaacgatgaatgggaaactagtgttgaaataggattcattttacttagcaccagcttaatttccttaggaagggctcatgtccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattaaaatatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaatatttttaactgctgcttgtcattctttgtaatacataacagctttaaaatcatattttagaatcaggaacgaagattcagggaatgtctgtcacatcttatggcatcccacctggacagaatatccgatttgaagattgtgattgacttccgtaaaactgtacaactctccatttggcaggtacctactagataatactttgccctgtattaaatgtcaaggggcaaagcctattcctgtgaattcctgctggttgctttgctgcattaggtccctgtccactgtaaatcatcattcctgggaattctacttctgcccaagtgtgtaaagaatcagctcacctattagagaaggggtagaaataccttctgtgtgcattatcacaataactgtgtttacactaaagaggtgtaaatacagtcctctgaaattttgtaccagaattcccaagtagtgtaatgagataatgatccagaactgaaactacccttaagaaaacatttttggaagggagaggtaaatagcagtagggggtttcttgtgaaaaattaacctccatccttaagagggctgaaatgaacagccaccaaggttctagtcctgctctataaaatctgagatcaaaatactacctaacctgcacataatctcaattgtgacaaccatctgaactatctcatttaatatgtaacaacaaatacaagctcaagctttcaatatgagaatattaactacatgttacatatgatgcttgacctgggcttccttaaaaaggtattcgttatccaaaataaatagctcaaattgcagcatatattcatctcaagtaactataactgaatttgaacagtaatacactgcaaactattctttgttaatagaacttttctaatcatttgtgttattttgctttgtaccattcattttcattaaaaagatacaaagcccctttttttcacataactttagataaatgttacaacttcagaaaaagttaattcataaaaataggatgaacctttccacaggctaccaaagactccagtttttggaataatacatattataaccttgatgccaagcttagtccatcaatccaataaataggttttctctttaatgtgtcatagcctcttttctgatataattgaggattacaatgttatttaagcaaataaccagtattaattcagccaaagatgttatcagttttaaagatttttaaaaatttataatgtggaagctgtaaaataagttattcagaaggcactacacaatattgtttttgccttactgtcatcactcgagtatcagtaattatgactcactgaaaaagtcgtgctattaagtgttcttgtggcaaaaactcttaagtcaaatgggttttcttacctaaattgtaaactctgagctccttaagaatagggatctaatcttagcaacttttctattccactagctgctacataataggtgcttaatgtttgtggtgtgaatgaaataactgaatttgaatagaagtttacatccaaaagtcataataagacaaataatgaaaaactccaaagtcactgattataaagaatatgcaatccatttgggatttattgcatttaaagaaaacagattaaaacaggtatgataaatacagtaagaaaataactttaaatttcaaacaaaacagtgaatcagggacagaattcagtcaaaaagaataagcagtgtaaaggcaataaagtaataaaatcagttagtgcttaattagatatggcaggggaaaaggggtgggagggggagactgagtctatctcataattgtttcccagctatatttgaggactgaagttactttagcaagtatgttttgtaacaagtagaaatacaataaagatgtaaatttgctttatttaaaggttaaagttatttgcttagtggtacataaaaggcttcagaaaattcaagtttaacaaaaaatggaagtgtaatcaaagaaagtgcacttaaagctgtttgccagcaattaaaaagtagcttctatacagcttctattagatgacttttcaatcacaaaaagagcatagtcataaaaacaattctttcaaaagtagcagtataaattttaaaataaaacaaaaataaccccaaatcatgaccctttgcattatcatctaccttattctcttagtagcttttgtaaaccctcactaggagtgaatgttctcttagatatgattgtggttgcaattccattttttaaaaattcacattaactccacagtagagagatgtgacatgcatgtgtgtacatatttttatcttaatatataaaacaccactgagtataaaagttctcaaataaactattcatcatttatggtattctcacagtagatatgtcatctcattctcacagtagactgtcaactcaataattggacctaaaataacaagtttgctaaaaagaaaaaaaaatgagaaaaaagtttactgcacattctaaatatattaaaaacaaatgtacccaagcgcctcaaaactagtgatattaatacacttgtaccttctaacagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacagggtaagactgaaagttgtgtctatttgcaaatccggataatgtcgtaactatacccaacacgtacacagggattggggtaagggaaaataattacactcctgaataaatgttctagtcagttaaattttcatccggcctacaacctttcctcctccacctattatacttaccatgcaatttttgtgtcttagcagatacattcttcaatgccataaaaagctgatctttttaatactaacattttactgacgtgatattaaaataagcaaatggtccactttttaaaggattattcaaaatcaacaagcattattaaagctgttaagaaacaactttggcctcaagatttttgctagcttcataataatttacttctcttagtgatgttcaagtataacaggtttagttataactacatcctaaagaagcacaggggacacccaaataatattagggaaaaaaaaccccaaatatatatatatatatatatttgcttagtggtacatatataataacctttcttccttccttaaaccagaattgaaccatcccataatagagccaaacttttattgagtgctgtgtgccaggtactgtgttaagcactttcacatatcttgggagctttattctcataattctcacaagggaataacctgagcatcagctgtgtggagtgacctacaccttgaccatgattctgggggatgatgaatgaaaatgcaaagtataaatctatactccttaggaaaatgcctctactacaacacaaaggaatctctccatttctatcctattgaacccccaattgaatcctgtatcttttctctgagctacaatcttgaaagaagaaagtcactgtgctgtgttataagaatgtaaatattttatgctgtcagttgtttcctcagaatttataagtcaaagggtctacatcagtgtcagaatcatttaaaattattcagtgtattgaaaagcaagtaaaactctaggtatttcatgtttacatctgaaggagacattagttcatcctctaccccttttctaaatgatgaaactcatgaggtctagcagagaccaaggactaatacaatcaagaagcatattgtgtacacctcaacagattttcattaaaaaaaattgtttgatacaaacctactgtagttcatgaatttactatgtgtaatcatcaactcttcacttttaaaagaaagtatcacttgaatctattttgtaaagtttttaaacatctacttgagcatttgcattagcagtattaatcaacctgagaatcagaaaaaaaaaaaaaggtgcaaacatatttgcctttggcacgaggacaagtaattggtgcagtccagctctaaataataatgtaatgcttggtctgcctctgctacattgtgattcacatattgcttccctatccacaaatctatatttgatttagcatataaaagaagggaaaaagcaataaaaagacaaatatgtggtttagttacatatactttgcttctttccaagttcagaactgtgaaaataggcaaatagcttatcccattggggcactataagagattcctaataaaattactcgtaaaatatactttgagatcgaagagagttaatttaaaatataaaaatcaaagagagtgccagttgatgagtttctactcctttctgtaaatagcattaactgttctagaaacttccaaatgttaatctgatagcgcagcacaattatatcttaaaatagtcatagacacaggaagcacagatactatattcacattaattcacatatgtaatctctatcattaaatgatttctataaaacctcaagtttctaattaggatttgtggtgtaaaaaaaggcaaattggtagctgggttcttttcagtaaagacacaatcaactagcagaattaagatgctagtccaccttatatgcattttaggatctggtatattagtgcagaggtacttgcagcaggatgcatgaatcctgcctttatataaggctttgtgggtgtcaccattctgtgcactttattaaaactactccaccccccaaaacctaataaaaataattgttgcttatgacttggggaatatttggtgaagttgctaataaagtacattgttaaatgcaacatgatttcacattgtaaatgtcttgaaaattcagtttccgctacatattttcttcataaaataaaatttttatacaacccttgtcctccaatttttccaataatctgctttattagggccatcacaataaaagtttggggcaagaagccatgcataaagtgtttctaaagtagtgaatgttttctgttctgtatctttttttcttcttataatttctttacaaatgtcagatatttctcttcatatttttgttctaggcttctgtgcgacgatagtccatttttttaatttgttttaactgacaaaaattatatatatttatcatgtataacattgttttggaatatgtaagttgtggaatagttaaattgagctaattacacattatttcatatgcttatcattagatattccattttaatggcacttgtttttaaaaatgaaacagagttttaggcacaatagtcagttacttctggctctgctttgtggagaaaggtgtatggactgaaatctctgcactctccagataataactttctaatgctttaagataactagattgtttttaactgtctggaaattaaaagagaccttaaaaaaaattcacaagtgtaactagtgtatgtagaaataaccctaattttagggatatgcacataaaaatgacattctgatatcaaaaataacagtttcactgtcccttctcagtggctacacacctagaaaggtgccatgtgctttcactggaagtaccacacttgcatttctgtgttgtgatgtcagtagcagaaacccttagttagagcttgcaatttagctcccttttctcctgaagaggaatcaagttactaccctgtagagatacttcattcttctatttggtttatttagaaatcacctattctgactgatctttaagaatgaatgctataaagagctaccaaattttctttcaaattcataaaactgttcacacttttttgaaacaggagttaatgccgagaatccatcagaagtatctactgtttagaaggaaatggagcagcaccaaatgggtctaattcgactggttgggactgttgggactgatgtggagtgatgctttgcaccacaagttctgtaaagggcacggcaccaaaatcatccattttcaatacatctgcactatggaatga

SEQ ID NO: 5066 - DNA, 2468 bp, Homo sapiens
tggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgt

SEQ ID NO: 5067 - DNA, 2793 bp, Homo sapiens
aggagcccggcgcgcgaaacgctggccggccggcgggaactaggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaagcctt

SEQ ID NO: 5068 - DNA, 2103 bp, Homo sapiens
atgccgcggcgcctgcagccccggggcgcgggcacaaaaggccctccggccccggccccggcagcttcgggggccgcccggaactcccactctgccgcctcccgggaccccccagcgtctgccaagccgctgctgcgctgggacgaggtgcccgacgacttcgtggagtgcttcatcctgtcgggctaccggcgtctgccgtgcacggcccaggagtgcctagcctcggtgctgaagcctaccaacgagacgctcaacttctggacgcacttcatcccgctgctgctgttcctgagcaagttctgccgtctgttcttcctgagcggcggcgacgtgcccttccaccacccgtggctgctaccgttgtggtgctacgcgtcgggagtgctgctgaccttcgccatgagctgcacggcgcacgtgttcagctgcctgtcgctgcgtctgcgcgccgccttcttctacctggactacgcgtccatcagctactacggcttcggcagcacggtggcctactactactacctgttgccaggcctcagcttgctggatgccagagtcatgactccatacttgcagcagcgcctgggctggcacgtggactgcacgcgccttatcgccgcctaccgcgccctggtgctgcctgtggccttcgtgctggcggtggcttgcactgtggcctgctgcaagagccgtaccgactggtgtacctacccgttcgcgctgcgcaccttcgtcttcgtcatgccgctcagcatggcctgccccattatgctcgagagctggctcttcgacctgcgtggggagaaccccacactcttcgtgcacttctaccgccgctacttctggctggtggtggccgccttcttcaacgtgagcaagatccccgagcgcatccagccgggtcttttcgacattatcggccacagccaccagctcttccacatcttcaccttcctcagcatctacgaccaggtgtactacgtagaagagggcctgcgccagttcctccaggcgccgcctgccgcacccactttctcgggtactgtgggctacatgctgctgctggtggtctgcctggggctggtaatcaggaagttcctaaacagctccgaattctgcagtaaaaagtgagcctccgccttggaggagactactggttcgcccatctgtttggagtttctgttgttgctattgttggtttgttttcaaatttcattgtgttttcttctttgctcaaggaaggtgctgcaaaaccatagggaaaaagttcactgctacaaagggatcccaacccactggaggctttgaagtagggaggttggcaggggtggtcaagcgggagggagatagtcacttgttcttgcccctggaaaaaattcaggtgatgtctttgacatccagggatttctcaaaggcagtgagtaaaatcccaaataaagccccaaagagtttgcttttccaatcatctgtgccattggtaataaggagtagcccctgtgaggtcaggtacacagtaaagagggtaaatagaatccttgggaacttctgtttcagtctgaggaatgcttggatttgtcaaaagaatggagctttgtaggaaacaggcacaaagacgcaaacccagggcttaacctgctagaaaatgcatggaatgtgaacacaagttaattatttcaaaatgtttttcagatgttatttaaatagtaatatatacattgatttttcataatttatcaaagcctgtggtacgcactgaattttctttgtcacatagttttgaatttcacagccttctgcattgcatacacttgaactggacatcaggggaagctgcttgagagttctcaattactttcttaaacagtgttttctgaaggcgtgtgtcatgatacaactgtgaattctaccttagggactctggttaaactattggtgaggagctcgagtggtttgtatagaccccagatttttgtttactttaatgtattccacaaaacccatcctggtttttgttagtttgttttgtttttaatctttttttttccttctctacttatttaaattgccactggaataaatgtgccttttgaagcaaagtcc

SEQ ID NO: 5069 - DNA, 5480 bp, Homo sapiens
agcttaacaagaccatggcctctggacccgcgatcagctcgctgtgtggtcctgagcagccacccaacatctctgggccttggattcctacctggcctttcttctggatgcatcatttttgcctttaggtatctggaccattcccccccatggatgataaagtctttgcttcacaccctcaggattaccttaaaggcctgaaaagaacagaggaggagtctgaggaggtgaattccagccgtgctcttgcaggctggctgggcagtgtgctggggaggagagggagcctctggctgggcctcctccaccgggcctggtgtgctgggaacaccccgcattgtcccaaggcctcagatttgactttcaaagggaaaacagctctcctgataaaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtgggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccaggtttcttgaaatccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatgactcagaccataagcttttcatgccagatgtcaacattaagctgcaacatcctaaccaccataagccggaggtggttacagcttatcatggcctaaaatattcataatggttggtgtcttttgaatgaattcatgtcaaaaatgttattcagctggggaaatttctctaaatgtacactgattctgtgtgtgtgattttaaaaggagaatatggttcaagcaagtccttgttaaggcaaactattgatatttcattaattttaaatttacttaaaatgtggttttaaattctatttaaacatttggattaagcatattactctggagctttgtattattctttaaaaatgaatcttgcttcatttgatgaatttcatgtcacaaagcttctctcaagagctctcgtagtggcctgtcaaccactttcggagaatgagccaggtcagtcactgggaggacctgtgaaagaaagttggtcactgagtgccttggggactggcaaaacattccagaatgaagagagctgtctggggagagcccttcttcccttctccacctagtgaagggagaacagaaggggagtcctctcttcccacaagtccattctgccttcaaagtgtaagttctcatgtcattatggatttggagtttgtcagtttttttcttaaaagtccacagcggggtgtcatgtgttctgttatgttctgttttctggttgccagtttgatctgcaaagtatttttcagtgcaggtaaaatgtgttaaaccataagagttgactgagttaatcccaattggttgtgctcatatgccaccttttaaaccaatggaaattgctatatttggggatgtcatacatttgatattgcttcagcatttcaaatatgttgcaaaatttagtatccatatgcataagaagttaatcaccttgccagtggggtggtcacatatagtgttctcaagctttactgtgaatcagaaacatccagtaagcttgtgacaaatgcagactcctagggaaaaccagggggttctgcttcactaggttaaatgtaggttttgtagaggagatctgcactggagcaagtctcccagatgattctaatacaggagggccagaggccaaacttgaagaactgctggtgttacatgttccaaaaggcattagacctatcagctttgtttcgcctgatctcaagttttagcaactcaccaactaaggcgtaacctcattttatgttccagcgttttctactctgaatagttctaaaacactgagcattttctcatttgttgcattactgattaaagttcagtatttcatggtgttttcagggaacacagaaatgcggatgcaaaacaacttttgacagaggcccatcaaacccagatctgcacttggtaatgacttaggggggcttcctcacaatgcaggatcctctttgctgactcaggaatactccatattttagactactgcctctaccattaactagcccagacatttgaatggccttgtaaacagctcactgtctaatactcgaaggacaagtaacaatttatattggatgagagtggtcaagaaatatgatttcgttagttttattatctgtttacttcctctggggaaggcagactgataaaattatatgggctggtaaatttttggtacattaattgcaagctgcatgacaaaatttgtttttctggcaacaatctgacattattagtggaattccacaccaacagggcttgtgagcttccatttcatcttactgtaacttcaattttatggcaaaaaaaggtacaaagtttaaatacccctttctagtaatgccaaagacatacagtgttttacattctctcctttataggtaacaaaataatgtttagctcagtaagtactgaaataatgagtgaccaatttgaaggatttttagattatttaatctttgcttatgttgctttttcacatgcttaatgatggaaatgaaatgttaaatcaacaaaataagatccagtgtttcataacatttttataagtttggtaaactttagtcccattatatacttttggggacagtgttataaatcagaattttacgacagtttgcagaacactgatttgaaagcttcctatgcaaaatgagaaggggttcaaatatattaattatcattaagtattaaataataggcattagatgtctaatgtgagtataatttcatccaagccatctcagaaagtctaaaaggttggcagggggtcagctgaagacctcactggagtgggtcttaatttttaaaaagtgtctcactacatttaagacatgtgacacattcccattggtaacaattgctcaccatggcattgtctcaaaaaagactatggtggggagggtggcacattcctaatgggatgtacctctccccactccccttgcttgagaagcactactcaaaaatttaccagaccttacaactgtgataaaacttgaatgtgtatgatgaataaggccattcagttaactttacctccctttacccattgaaggggttccttttccattgctcagtttttagaaaataattctcatcttttttctaaagaaatgaatttgtggctggtctgaaggtagtgagttagctcaattgattgttcgcagtcagttatagatcaagctccttgttctactcttcccctcttctcactactgcacttgactagtcttaaaacaaagaaagaacgaatgaatgaatgaatctgtggctggatgcagtggctcatgcctgtaatcccagcactttgggaggctgaagtgggaggactgcttgggcccaagaattcaggaccagtctgggcaacagagccagacactgtctctataaaaaaaagttaaaactagctggttgtggtggtgcacacctgtggtcccagctactgtggagggtgatgtgggaggattgcttgaacccaggagttggatgctgcagtgagctatgattgcgccattgcgctccagactgggcaacagggcaagaccctgcctcaaaaaaaaaaaaaaaagaatttgtaattgttggtaggatgttatgggaaatttagaggtcttctgagtataaagtggtttaaatatttggtctgctgaagtctttctggaagtgttgttccccctgctgccccgcccagtagaaacttgctcatatgagaggttctgaggtaggtgcggtgtagtagaatggcattgtcagatatgttcaagaaacccttcatttgacactattttgtaccttatggtaccctttaacattttttaattaaaaaaaatattttttgagacagggtcttgttctgttgcccaggctggagtgtagtgttgcaatcttggctcactgcaacctctgcctgacaggcttcagtgatctttccacctcagcctcctgagtagctgggactacaggtgcatgccaccaagcctggctaactttttgtagagatagggttttgccatgctgcccaggctggcttagaattcctgaattcaagtgatttgtctgcctcaggctcccaaagtgctgggattacaggcatgagccacactgcacccagtccatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcata

SEQ ID NO: 5070 - DNA, 5337 bp, Homo sapiens
gggcccgcgagtccggggtcgccgcagcccgggaggagtgtctggtctccggcctgcctgtgctgtccccgcgccctgtccactggactcccgagacccttggaacccaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtgggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccaggtttcttgaaatccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatgactcagaccataagcttttcatgccagatgtcaacattaagctgcaacatcctaaccaccataagccggaggtggttacagcttatcatggcctaaaatattcataatggttggtgtcttttgaatgaattcatgtcaaaaatgttattcagctggggaaatttctctaaatgtacactgattctgtgtgtgtgattttaaaaggagaatatggttcaagcaagtccttgttaaggcaaactattgatatttcattaattttaaatttacttaaaatgtggttttaaattctatttaaacatttggattaagcatattactctggagctttgtattattctttaaaaatgaatcttgcttcatttgatgaatttcatgtcacaaagcttctctcaagagctctcgtagtggcctgtcaaccactttcggagaatgagccaggtcagtcactgggaggacctgtgaaagaaagttggtcactgagtgccttggggactggcaaaacattccagaatgaagagagctgtctggggagagcccttcttcccttctccacctagtgaagggagaacagaaggggagtcctctcttcccacaagtccattctgccttcaaagtgtaagttctcatgtcattatggatttggagtttgtcagtttttttcttaaaagtccacagcggggtgtcatgtgttctgttatgttctgttttctggttgccagtttgatctgcaaagtatttttcagtgcaggtaaaatgtgttaaaccataagagttgactgagttaatcccaattggttgtgctcatatgccaccttttaaaccaatggaaattgctatatttggggatgtcatacatttgatattgcttcagcatttcaaatatgttgcaaaatttagtatccatatgcataagaagttaatcaccttgccagtggggtggtcacatatagtgttctcaagctttactgtgaatcagaaacatccagtaagcttgtgacaaatgcagactcctagggaaaaccagggggttctgcttcactaggttaaatgtaggttttgtagaggagatctgcactggagcaagtctcccagatgattctaatacaggagggccagaggccaaacttgaagaactgctggtgttacatgttccaaaaggcattagacctatcagctttgtttcgcctgatctcaagttttagcaactcaccaactaaggcgtaacctcattttatgttccagcgttttctactctgaatagttctaaaacactgagcattttctcatttgttgcattactgattaaagttcagtatttcatggtgttttcagggaacacagaaatgcggatgcaaaacaacttttgacagaggcccatcaaacccagatctgcacttggtaatgacttaggggggcttcctcacaatgcaggatcctctttgctgactcaggaatactccatattttagactactgcctctaccattaactagcccagacatttgaatggccttgtaaacagctcactgtctaatactcgaaggacaagtaacaatttatattggatgagagtggtcaagaaatatgatttcgttagttttattatctgtttacttcctctggggaaggcagactgataaaattatatgggctggtaaatttttggtacattaattgcaagctgcatgacaaaatttgtttttctggcaacaatctgacattattagtggaattccacaccaacagggcttgtgagcttccatttcatcttactgtaacttcaattttatggcaaaaaaaggtacaaagtttaaatacccctttctagtaatgccaaagacatacagtgttttacattctctcctttataggtaacaaaataatgtttagctcagtaagtactgaaataatgagtgaccaatttgaaggatttttagattatttaatctttgcttatgttgctttttcacatgcttaatgatggaaatgaaatgttaaatcaacaaaataagatccagtgtttcataacatttttataagtttggtaaactttagtcccattatatacttttggggacagtgttataaatcagaattttacgacagtttgcagaacactgatttgaaagcttcctatgcaaaatgagaaggggttcaaatatattaattatcattaagtattaaataataggcattagatgtctaatgtgagtataatttcatccaagccatctcagaaagtctaaaaggttggcagggggtcagctgaagacctcactggagtgggtcttaatttttaaaaagtgtctcactacatttaagacatgtgacacattcccattggtaacaattgctcaccatggcattgtctcaaaaaagactatggtggggagggtggcacattcctaatgggatgtacctctccccactccccttgcttgagaagcactactcaaaaatttaccagaccttacaactgtgataaaacttgaatgtgtatgatgaataaggccattcagttaactttacctccctttacccattgaaggggttccttttccattgctcagtttttagaaaataattctcatcttttttctaaagaaatgaatttgtggctggtctgaaggtagtgagttagctcaattgattgttcgcagtcagttatagatcaagctccttgttctactcttcccctcttctcactactgcacttgactagtcttaaaacaaagaaagaacgaatgaatgaatgaatctgtggctggatgcagtggctcatgcctgtaatcccagcactttgggaggctgaagtgggaggactgcttgggcccaagaattcaggaccagtctgggcaacagagccagacactgtctctataaaaaaaagttaaaactagctggttgtggtggtgcacacctgtggtcccagctactgtggagggtgatgtgggaggattgcttgaacccaggagttggatgctgcagtgagctatgattgcgccattgcgctccagactgggcaacagggcaagaccctgcctcaaaaaaaaaaaaaaaagaatttgtaattgttggtaggatgttatgggaaatttagaggtcttctgagtataaagtggtttaaatatttggtctgctgaagtctttctggaagtgttgttccccctgctgccccgcccagtagaaacttgctcatatgagaggttctgaggtaggtgcggtgtagtagaatggcattgtcagatatgttcaagaaacccttcatttgacactattttgtaccttatggtaccctttaacattttttaattaaaaaaaatattttttgagacagggtcttgttctgttgcccaggctggagtgtagtgttgcaatcttggctcactgcaacctctgcctgacaggcttcagtgatctttccacctcagcctcctgagtagctgggactacaggtgcatgccaccaagcctggctaactttttgtagagatagggttttgccatgctgcccaggctggcttagaattcctgaattcaagtgatttgtctgcctcaggctcccaaagtgctgggattacaggcatgagccacactgcacccagtccatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcataaagtcatcctgtttgccacttaatttggttatgttttatctaccacactgcaaatatgttaattcaccatgagaaacagatccctgtacacatgtgtatcagtaaatcattcaatgaatagttagtgcttaggatgtat

SEQ ID NO: 5071 - DNA, 2347 bp, Homo sapiens
agcttaacaagaccatggcctctggacccgcgatcagctcgctgtgtggtcctgagcagccacccaacatctctgggccttggattcctacctggcctttcttctggatgcatcatttttgcctttaggtatctggaccattcccccccatggatgataaagtctttgcttcacaccctcaggattaccttaaaggcctgaaaagaacagaggaggagtctgaggaggtgaattccagccgtgctcttgcaggctggctgggcagtgtgctggggaggagagggagcctctggctgggcctcctccaccgggcctggtgtgctgggaacaccccgcattgtcccaaggcctcagatttgactttcaaagggaaaacagctctcctgataaaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtggtaaggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccaggtttcttgaaatccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatgactcagaccataagcttttcatgccagatgtcaacattaagctgcaacatcctaaccaccataagccggaggtggttacagcttatcatggcctaaaatattcataatggttggtgtcttttgaatgaattcatgtcaaaaatgttattcagctggggaaatttctctaaatgtacactgattctgtgtgtgtgattttaaaaggagaatatggttcaagcaagtccttgttaaggcaaactattgatatttcattaattttaaatttacttaaaatgtggttttaaattctatttaaacatttggattaagcatattactctggagctttgtattattctttaaaaatgaatcttgcttcatttgatgaatttcatgtcacaaagcttctctcaagagctctcgtagtggcctgtcaaccactttcggagaatgagccaggtcagtcactgggaggacctgtgaaagaaagttggtcactgagtgccttggggactggcaaaacattccagaatgaagagagctgtctggggagagcccttcttcccttctccacctagtgaagggagaacagaaggggagtcctctcttcccacaagtccattctgccttcaaagtgtaagttctcatgtcattatggatttggagtttgtcagtttttttcttaaaagtccacagcgggg

SEQ ID NO: 5072 - DNA, 1908 bp, Homo sapiens
actccccgcccaggcctggcccgcctgcctggccactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagca

SEQ ID NO: 5073 - DNA, 2117 bp, Homo sapiens
ttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggtgagggcacgcctggcccggcccgggaagaggcaggggcagatgccttcccagagcacagaatgaactgggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagc

SEQ ID NO: 5074 - DNA, 1799 bp, Homo sapiens
actcttcctccatcagcctggctggcagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctggtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttg

SEQ ID NO: 5075 - DNA, 1926 bp, Homo sapiens
tggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggtgagggcacgcctggcccggcccgggaagaggcaggggcagatgccttcccagagcacagaatgaactgggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagc

SEQ ID NO: 5076 - DNA, 1906 bp, Homo sapiens
ctcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggtgagggcacgcctggcccggcccgggaagaggcaggggcagatgccttcccagagcacagaatgaactgggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagc

SEQ ID NO: 5077 - DNA, 1765 bp, Homo sapiens
cagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaacttt

SEQ ID NO: 5078 - DNA, 1094 bp, Homo sapiens
ctgcctctaccccttcgcgtcgtgctgcgcgcacaccttcagctccatgtcgccccgcatgcgccacatctgctacttcctcgactacgacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagc

SEQ ID NO: 5079 - DNA, 1491 bp, Homo sapiens
actcttcctccatcagcctggctggcagcagccttggactccgcccgtggagccctgggcctgttgacccaccagcttaggagcacccaccaagctctggcagggtctccagcacccatctcgggcagaggctgggggagtgactgctggtgcaagccccaaagtgcatgcggcaaaaacatggatgcagagctggtggcaagaagaggggctaagttatagagtcaacgtggaggtaccaggccaccatgctcagtctcaagctgccccaacttcttcaagtccaccaggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagt

SEQ ID NO: 5080 - DNA, 4655 bp, Homo sapiens
cccgatgttgagtctccgaatccaagcccggaaggggggacgacggggtctcttgcctgctgtgtactgcttttactgccagaaatgttctcctcacctgggagccagttggctgccaacactgagttgcataccctgtcctgagggcgcggcacggagtgcatgcgggccgctgccatgacgaccgccatcttggagcgcctgagcaccctgtcggtcagcgggcagcagctgcgccgcctgcccaagatcctggaggatgggcttcccaagatgccttgcactgtcccagaaacggatgtgccccagctcttccgggagccttacatccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctgctcctcttcatcctgtcgtcaatcacttacctcacctgcagccttctggcccacctgctgcagtccaagtcagagctctcccactacaccttctactttgtggactatgttggcgtgagcgtttaccaatatggcagtgctttggctcatttcttctacagctctgaccaggcctggtatgaccggttctggcttttcttcttgccagcagctgccttctgtggctggttatcttgtgctggctgttgctatgccaaatatcgttaccggaggccttatccagtcatgaggaagatctgtcaagtggtgccagcaggtctggcttttatcctagacatcagccctgtggcacaccgtgtggcgctctgtcacctggctggctgccaggagcaagcagcctggtaccacaccctccagatcctcttcttcctggttagcgcttatttcttctcctgccccgtgcctgagaagtacttcccgggttcctgtgacatcgtgggccatgggcatcagatcttccatgcatttctgtccatctgtacgctctcccagctggaggccatcctcctggactaccaggggcggcaggagatcttcctgcagcgccatggacccctatctgtccacatggcctgcctctccttcttcttcctggctgcctgcagtgctgccaccgcagcccttctgaggcacaaagtcaaggccagactgaccaagaaagattcctgaggctggcaagtggggcaacgtgtggaggaagcccctcataatttggagaaaacttgatacaatagaagctgacttttaaggcattggcttttaaattaatacatatatccaaggatatgttatagctgcagtgtttgaaagccaaaggatttaagagttttgttgttgttaataaaaggaatactccttttccttttggatcatagcttaacaaggcacaggaagggaagggatcttgactaagattcatgagacattgaattaaggagaatcatcttcatgcctgaaaatttagcaaaattccgactatggcctccaggggcaattcctaaaagctgaatggataataaaattggactggaaagtaagtaggtggctggtcctcaccctgttggaatggctatcctactatgctgttctttggtaatggaataaattgacccaaggaccgaatttcatttggatttcaaattgtccagagtggaaaagccttcaagatgacatgatgaattactcagttcatctgatttctggtccctcctttctcgacaactataatactaacccttttctcaggataactgtctacacctggcagttttctctgacgtgctgttcactcacatccctaccttgcatggtaatataaaggactaggaagcagtcatacttccaggaaatgcttggattcatgtggacattcaggaagcttattctcatataatactaatctaaacagtactagaaattacagtgccaagagccaccaggaggcccagccaataagcatagatactatatggtatcatgggacccatctattttttaccagtggactacaggattacttgagagttatcagggctgcctaacagaccaggagatctgggggttgcaccagggaatcgccatatttgaccagcatgttttaaaagctcttggtaggattagttggttctaaggatccctctagggacctcattatttcaagaggaacccaaagtccagcctcctacatagatgctgccccacgaaggacccacaaaactaacctagttcagggttctcaggcaggcagttctgcttcagcttagagcagaacccataaaatactcaagtactgggataggcaagcatgtgtgtttactgtggattggtccctgaaggctcctttgggtgagaacatgtgaaccaggcaccctggtttgtttggagcattgctgcccagaagcttctatgggataggtggtgcttgggattgatgtgttgtggccatgcagccctccctgaggattgacttctgcactaatccagtgaaggaggctgtgtcaaaagaagggctcagaagccctcttttcagaggcaatgattcctgtcagtatgaggtcccttagttactaaaaagggacatgatttaactccagtttgatgaacctcctccgagtttactttattgtcttcaaatcttttgttttcttcctttttgtgagatttgtgggttttgtgccttataaatggaaatgtatgaacacaatatatgctcatgtagaattttctgttctgggttattgggataagaaaaaatatatattgctcttcaactagtgaatgaaagaaacttcagaaagctagaattgcttatcaatcaaaagactttctcaatctattttggccacaaacaaacatattcaactgaagctttccaataatctttatatcaagaaagcatgcgtcttgtcagctacattgttttcttagatggatttctcctgttaatcctcaaatatctgaacttctgtgttacccaagtgtcttatacaagcttctggtgtctaggacaaatttatggcaaataaaattagcaaaactgaactgggttgaactgaacaagaggatgggggaattgtgcaaatacgttgttagtagaaggtcaatttaaaatagggactagaaattatttgaagttttctttattacggattcaaagacttattttgaaagttggaaggagaagggagggaagagagcagaagggaagaaggtgtaagtcaagctcttgaatataactggtggtattgtgggcagagatctttagttcaaatccacgtattttttaaaagagagaaccggaggtagagcaatgatcagatgggtgcacagaccagtgccaatctgaacattgttaatggcctgtgacatgatgagcacaggaacaggcatgaagatattgccatacaattttaatttatacaagtattggcccctcaagtggttggaaattttttttttaatctctttttctgagacagggtcttactctgtcgcccaggctggagtgcagtgatgcaatcacggctcactgcagcctcgacctccccagctcaagcaatcctcccacctcagcctcctaagtacctggtactacaggcgcgtgccaccacacctggctaatttttgcattttttgtagagacagggttttgccacgttgcttaggctggtcttgaactcctgaactcaagtgatccgcccacctcagcctcccaaagtgttgggattacagacattagccatcacgcctgccctagaaacagttttttaataggagatatttgagaggcattgaggtaggagactctatgacatgccctcagaatatcagaatcttcttagaaataaactaggaaatgcagatgtttttaactactcagacttttgaggaattaatccttttaaaacatttttgttaaagttagtgtatcagtaagaaacagacctagtttaaaaggaataatcaacaattttataaaggagatggcttattcaaccatagcccctccaacatatctactggaaattctgctggttaactttatctctctctctcttaatttagactttcaacctatgaaaatgtaaatacctttgaaaaaactaaactatcagtcatttacatcctctcatgaatgaaatgcagtgtagggagaggagatggcaggacacagcaaacaggacacatttgcctgcttctctcttgcctaattcttcctgacctgtatttactgatgcttaataatacttgtaagactctaggggttcatttcccatttcagcggaaagtacttcactcaacaacaatattctcaagagtcttctactggaagctagaaagaaataggaatttaagtccatagaatgaaggtagttattcctgcctgtgttgcccacctgttcacaaaaagtacctttatgcttgaaaacattaggttctttggttactgcactgtagtttcaaatggatcctccagatggcattcatgtcttactcagaaagggcactgccattgtccccaaggcttctgtctactaattctattggtcttgtgttttgcttgcttggcaaaaaaaaaaaaa

SEQ ID NO: 5081 - DNA, 4738 bp, Homo sapiens
cccgagccgagcccgccgcggtcacagccacccgcgggaagctcgtggccgggaccccgaggcgggagcgcgggctgggccgggctgggctacgcgcacgggctcggccgccgcccctgccggttgcataccctgtcctgagggcgcggcacggagtgcatgcgggccgctgccatgacgaccgccatcttggagcgcctgagcaccctgtcggtcagcgggcagcagctgcgccgcctgcccaagatcctggaggatgggcttcccaagatgccttgcactgtcccagaaacggatgtgccccagctcttccgggagccttacatccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctgctcctcttcatcctgtcgtcaatcacttacctcacctgcagccttctggcccacctgctgcagtccaagtcagagctctcccactacaccttctactttgtggactatgttggcgtgagcgtttaccaatatggcagtgctttggctcatttcttctacagctctgaccaggcctggtatgaccggttctggcttttcttcttgccagcagctgccttctgtggctggttatcttgtgctggctgttgctatgccaaatatcgttaccggaggccttatccagtcatgaggaagatctgtcaagtggtgccagcaggtctggcttttatcctagacatcagccctgtggcacaccgtgtggcgctctgtcacctggctggctgccaggagcaagcagcctggtaccacaccctccagatcctcttcttcctggttagcgcttatttcttctcctgccccgtgcctgagaagtacttcccgggttcctgtgacatcgtgggccatgggcatcagatcttccatgcatttctgtccatctgtacgctctcccagctggaggccatcctcctggactaccaggggcggcaggagatcttcctgcagcgccatggacccctatctgtccacatggcctgcctctccttcttcttcctggctgcctgcagtgctgccaccgcagcccttctgaggcacaaagtcaaggccagactgaccaagaaagattcctgaggctggcaagtggggcaacgtgtggaggaagcccctcataatttggagaaaacttgatacaatagaagctgacttttaaggcattggcttttaaattaatacatatatccaaggatatgttatagctgcagtgtttgaaagccaaaggatttaagagttttgttgttgttaataaaaggaatactccttttccttttggatcatagcttaacaaggcacaggaagggaagggatcttgactaagattcatgagacattgaattaaggagaatcatcttcatgcctgaaaatttagcaaaattccgactatggcctccaggggcaattcctaaaagctgaatggataataaaattggactggaaagtaagtaggtggctggtcctcaccctgttggaatggctatcctactatgctgttctttggtaatggaataaattgacccaaggaccgaatttcatttggatttcaaattgtccagagtggaaaagccttcaagatgacatgatgaattactcagttcatctgatttctggtccctcctttctcgacaactataatactaacccttttctcaggataactgtctacacctggcagttttctctgacgtgctgttcactcacatccctaccttgcatggtaatataaaggactaggaagcagtcatacttccaggaaatgcttggattcatgtggacattcaggaagcttattctcatataatactaatctaaacagtactagaaattacagtgccaagagccaccaggaggcccagccaataagcatagatactatatggtatcatgggacccatctattttttaccagtggactacaggattacttgagagttatcagggctgcctaacagaccaggagatctgggggttgcaccagggaatcgccatatttgaccagcatgttttaaaagctcttggtaggattagttggttctaaggatccctctagggacctcattatttcaagaggaacccaaagtccagcctcctacatagatgctgccccacgaaggacccacaaaactaacctagttcagggttctcaggcaggcagttctgcttcagcttagagcagaacccataaaatactcaagtactgggataggcaagcatgtgtgtttactgtggattggtccctgaaggctcctttgggtgagaacatgtgaaccaggcaccctggtttgtttggagcattgctgcccagaagcttctatgggataggtggtgcttgggattgatgtgttgtggccatgcagccctccctgaggattgacttctgcactaatccagtgaaggaggctgtgtcaaaagaagggctcagaagccctcttttcagaggcaatgattcctgtcagtatgaggtcccttagttactaaaaagggacatgatttaactccagtttgatgaacctcctccgagtttactttattgtcttcaaatcttttgttttcttcctttttgtgagatttgtgggttttgtgccttataaatggaaatgtatgaacacaatatatgctcatgtagaattttctgttctgggttattgggataagaaaaaatatatattgctcttcaactagtgaatgaaagaaacttcagaaagctagaattgcttatcaatcaaaagactttctcaatctattttggccacaaacaaacatattcaactgaagctttccaataatctttatatcaagaaagcatgcgtcttgtcagctacattgttttcttagatggatttctcctgttaatcctcaaatatctgaacttctgtgttacccaagtgtcttatacaagcttctggtgtctaggacaaatttatggcaaataaaattagcaaaactgaactgggttgaactgaacaagaggatgggggaattgtgcaaatacgttgttagtagaaggtcaatttaaaatagggactagaaattatttgaagttttctttattacggattcaaagacttattttgaaagttggaaggagaagggagggaagagagcagaagggaagaaggtgtaagtcaagctcttgaatataactggtggtattgtgggcagagatctttagttcaaatccacgtattttttaaaagagagaaccggaggtagagcaatgatcagatgggtgcacagaccagtgccaatctgaacattgttaatggcctgtgacatgatgagcacaggaacaggcatgaagatattgccatacaattttaatttatacaagtattggcccctcaagtggttggaaattttttttttaatctctttttctgagacagggtcttactctgtcgcccaggctggagtgcagtgatgcaatcacggctcactgcagcctcgacctccccagctcaagcaatcctcccacctcagcctcctaagtacctggtactacaggcgcgtgccaccacacctggctaatttttgcattttttgtagagacagggttttgccacgttgcttaggctggtcttgaactcctgaactcaagtgatccgcccacctcagcctcccaaagtgttgggattacagacattagccatcacgcctgccctagaaacagttttttaataggagatatttgagaggcattgaggtaggagactctatgacatgccctcagaatatcagaatcttcttagaaataaactaggaaatgcagatgtttttaactactcagacttttgaggaattaatccttttaaaacatttttgttaaagttagtgtatcagtaagaaacagacctagtttaaaaggaataatcaacaattttataaaggagatggcttattcaaccatagcccctccaacatatctactggaaattctgctggttaactttatctctctctctcttaatttagactttcaacctatgaaaatgtaaatacctttgaaaaaactaaactatcagtcatttacatcctctcatgaatgaaatgcagtgtagggagaggagatggcaggacacagcaaacaggacacatttgcctgcttctctcttgcctaattcttcctgacctgtatttactgatgcttaataatacttgtaagactctaggggttcatttcccatttcagcggaaagtacttcactcaacaacaatattctcaagagtcttctactggaagctagaaagaaataggaatttaagtccatagaatgaaggtagttattcctgcctgtgttgcccacctgttcacaaaaagtacctttatgcttgaaaacattaggttctttggttactgcactgtagtttcaaatggatcctccagatggcattcatgtcttactcagaaagggcactgccattgtccccaaggcttctgtctactaattctattggtcttgtgttttgcttgcttggcaaaaaaaaaaaaaaaaaaaaaaaaaaaaaaaatggagctattttctgtctatataaatctacttatatgaataaccattaaagtgattttgtatatgca

SEQ ID NO: 5082 - DNA, 582 bp, Homo sapiens
aattgatcatccaacttcttaactgtctttttctcatggtaaaataccgagaacattgtgggtgaggagcaagtcgggaggtggaacccacccccgcaccctgcctccaatagattgtatgtgtgggtcgctattgctgggacccacgaaggctgtggattgaggacacagggtagaagtgggatcttctgcaggttgcataccctgtcctgagggcgcggcacggagtgcatgcgggccgctgccatgacgaccgccatcttggagcgcctgagcaccctgtcggtcagcgggcagcagctgcgccgcctgcccaagatcctggaggatgggcttcccaagatgccttgcactgtcccagaaacggatgtgccccagctcttccgggagccttacatccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctg

SEQ ID NO: 5083 - DNA, 1135 bp, Homo sapiens
gataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagattgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgt

SEQ ID NO: 5084 - DNA, 672 bp, Homo sapiens
gaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatataggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttc

SEQ ID NO: 5085 - DNA, 458 bp, Homo sapiens
agaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaag

SEQ ID NO: 5086 - DNA, 1088 bp, Homo sapiens
cggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggctaccggctctctgaccagttccacgacatcctcattcgaaagtttgacaggcagggacgggggcagattgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttaga

SEQ ID NO: 5087 - DNA, 1156 bp, Homo sapiens
cggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggatgaagccccacccgcccttcaggatgccagccttggcaacattgtgagaccctgtttctacaaaaagtaaatgagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgcgctgctcctgccattggatcatcgcagcatttttcttttctctgatatgcacctttttcctcatcgtgggggctcacgttttcatagttccctctcactactaggttgtgagctgcgtgaaggaaggttcatagttgtgttgtatgtacaggcacacaaaatttgtccttggataaacacatatcctcttccttcttctctctgaatttctttattttaagaaaaaaattagagatggagtctcactgtcttgctcaggctggtctcaaactcctaggctcaagtgatcctcctgcctcagcctatactaatatgaattcctatactaatatgattgaaattagtttgatttctataataattgtgctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccacactgagaaggtatttgtggcccatacactgattccttcatgagacttgtttgcacaggagagctgctaaaaattactgctctcagggaggtctgtggtgaacaggtatgaagaagaagactgttctctgcccttctttttgcaataaaatgttccaaacta

SEQ ID NO: 5088 - DNA, 1602 bp, Homo sapiens
acgcctcgccaagagcccgcacctcggcgcctcacggccaccggaggcggggacagggagtccggcgcgggccgggtcgggggatctgcagcggcggcgcgaaggtaactcccccgccagagccgggaaagagccccgagcagaggaggaagggagcggggacctgcccttcgcctgccggcttctggaagaagcgtctcctgatccggccccggaataagaaacccggaccttgcctgccgggctccgcgatgccgcaggtttagaatggagctcagataccataccccaaagatgctggcagagacattctgactcattaagggagagctggctgatagcagagaggggtgacatcagccttgcagacattgccctggggaattctgagcagtgttgctcacagcaccacctggccagatggagaccaccatggggttcatggatgacaatgccaccaacacttccaccagcttcctttctgtgctcaaccctcatggagcccatgccacttccttcccattcaacttcagctacagcgactatgatatgcctttggatgaagatgaggatgtgaccaattccaggacgttctttgctgccaagattgtcattgggatggccctggtgggcatcatgctggtctgcggcattggaaacttcatctttatcgctgccctggtccgctacaagaaactgcgcaacctcaccaacctgctcatcgccaacctggccatctctgacttcctggtggccattgtctgctgcccctttgagatggactactatgtggtgcgccagctctcctgggagcacggccacgtcctgtgcacctctgtcaactacctgcgcactgtctctctctatgtctccaccaatgccctgctggccatcgccattgacaggtatctggctattgtccatccgctgagaccacggatgaagtgccaaacagccactggcctgattgccttggtgtggacggtgtccatcctgatcgccatcccttccgcctacttcaccaccgagacggtcctcgtcattgtcaagagccaggaaaagatcttctgcggccagatctggcctgtggaccagcagctctactacaagtcctacttcctctttatctttggcatagaattcgtgggccccgtggtcaccatgaccctgtgctatgccaggatctcccgggagctctggttcaaggcggtccctggattccagacagagcagatccgcaagaggctgcgctgccgcaggaagacggtcctggtgctcatgtgcatcctcaccgcctacgtgctatgctgggcgcccttctacggcttcaccatcgtgcgcgacttcttccccaccgtgtttgtgaaggagaagcactacctcactgccttctacatcgtcgagtgcatcgccatgagcaacagcatgatcaacactctgtgcttcgtgaccgtcaagaacgacaccgtcaagtacttcaaaaagatcatgttgctccactggaaggcttcttacaatggcggtaagtccagtgcagacctggacctcaagacaattgggatgcctgccaccgaagaggtggactgcatcagactaaaataa

SEQ ID NO: 5089 - DNA, 1182 bp, Homo sapiens
atggagaccaccatggggttcatggatgacaatgccaccaacacttccaccagcttcctttctgtgctcaaccctcatggagcccatgccacttccttcccattcaacttcagctacagcgactatgatatgcctttggatgaagatgaggatgtgaccaattccaggacgttctttgctgccaagattgtcattgggatggccctggtgggcatcatgctggtctgcggcattggaaacttcatctttatcgctgccctggtccgctacaagaaactgcgcaacctcaccaacctgctcatcgccaacctggccatctctgacttcctggtggccattgtctgctgcccctttgagatggactactatgtggtgcgccagctctcctgggagcacggccacgtcctgtgcacctctgtcaactacctgcgcactgtctctctctatgtctccaccaatgccctgctggccatcgccattgacaggtatctggctattgtccatccgctgagaccacggatgaagtgccaaacagccactggcctgattgccttggtgtggacggtgtccatcctgatcgccatcccttccgcctacttcaccaccgagacggtcctcgtcattgtcaagagccaggaaaagatcttctgcggccagatctggcctgtggaccagcagctctactacaagtcctacttcctctttatctttggcatagaattcgtgggccccgtggtcaccatgaccctgtgctatgccaggatctcccgggagctctggttcaaggcggtccctggattccagacagagcagatccgcaagaggctgcgctgccgcaggaagacggtcctggtgctcatgtgcatcctcaccgcctacgtgctatgctgggcgcccttctacggcttcaccatcgtgcgcgacttcttccccaccgtgtttgtgaaggagaagcactacctcactgccttctacatcgtcgagtgcatcgccatgagcaacagcatgatcaacactctgtgcttcgtgaccgtcaagaacgacaccgtcaagtacttcaaaaagatcatgttgctccactggaaggcttcttacaatggcggtaagtccagtgcagacctggacctcaagacaattgggatgcctgccaccgaagaggtggactgcatcagactaaaataa

SEQ ID NO: 5090 - DNA, 1980 bp, Homo sapiens
atttggatccgttcagctcccgcggagaagcgagaccggatcaccgacgtgggcagaggactaccgagggccagcagaaattctgccccttcttcccgcgagtgctttcccgctctccaaaccccactcccaggtggccatggcctcatcgaccactcggggccccagggtttctgacttattttctgggctgccgccggcggtcacaactcccgccaaccagagcgcagaggcctcggcgggcaacgggtcggtggctggcgcggacgctccagccgtcacgcccttccagagcctgcagctggtgcatcagctgaaggggctgatcgtgctgctctacagcgtcgtggtggtcgtggggctggtgggcaactgcctgctggtgctggtgatcgcgcgggtgcgccggctgcacaacgtgacgaacttcctcatcggcaacctggccttgtccgacgtgctcatgtgcaccgcctgcgtgccgctcacgctggcctatgccttcgagccacgcggctgggtgttcggcggcggcctgtgccacctggtcttcttcctgcagccggtcaccgtctatgtgtcggtgttcacgctcaccaccatcgcagtggaccgctacgtcgtgctggtgcacccgctgaggcggcgcatctcgctgcgcctcagcgcctacgctgtgctggccatctgggcgctgtccgcggtgctggcgctgcccgccgccgtgcacacctatcacgtggagctcaagccgcacgacgtgcgcctctgcgaggagttctggggctcccaggagcgccagcgccagctctacgcctgggggctgctgctggtcacctacctgctccctctgctggtcatcctcctgtcttacgtccgggtgtcagtgaagctccgcaaccgcgtggtgccgggctgcgtgacccagagccaggccgactgggaccgcgctcggcgccggcgcaccttctgcttgctggtggtgatcgtggtggtgttcgccgtctgctggctgccgctgcacgtcttcaacctgctgcgggacctcgacccccacgccatcgacccttacgcctttgggctggtgcagctgctctgccactggctcgccatgagttcggcctgctacaaccccttcatctacgcctggctgcacgacagcttccgcgaggagctgcgcaaactgttggtcgcttggccccgcaagatagccccccatggccagaatatgaccgtcagcgtggtcatctgatgccacttagccaggccttggtcaaggagctccacttcaactggcctcctagggcaccactcgaggtcaatctggtgcttattctcagcaccagagctagctaagccaacatagggcaacatttccagcccagccctcttgtccggctgtctgtcttgtccttgtgtgtttgtaaaatgttaagcgggctttggtgagagtcttgctctttgcttgggggaggccaaagagagggaagaggatttcttatttcttctttatgcccttgaaggacaaacaaaactttttctccacgttcagaaaagtatttcagaaccacgattgccttcctggcgtcccctcctcctgctcgttggtgaaatgaacaatatgaatgggatttaaaaggaatgcattgggcttggtaaagattttcagtttgcctttagaaaaaggacccagctgagagtaccatgatattgcttagtccatttgaacccttgcattcctagaatttcaggtaaatatgtattaaaactctacatctaggatttcagcatttcctgagtaagacctttatatgccaaaagggtttcgttttaaaaccacttgagtttatagtacaaaaacacctacaagctccctttagaaaggtcttgctattgtttctcccctttcctccccaactactatttaaaaatgatgagacgaattagtcaatgaagagatagataaataaagaggaaaag

SEQ ID NO: 5091 - DNA, 1796 bp, Homo sapiens
atggcctcatcgaccactcggggccccagggtttctgacttattttctgggctgccgccggcggtcacaactcccgccaaccagagcgcagaggcctcggcgggcaacgggtcggtggctggcgcggacgctccagccgtcacgcccttccagagcctgcagctggtgcatcagctgaaggggctgatcgtgctgctctacagcgtcgtggtggtcgtggggctggtgggcaactgcctgctggtgctggtgatcgcgcgggtgcgccggctgcacaacgtgacgaacttcctcatcggcaacctggccttgtccgacgtgctcatgtgcaccgcctgcgtgccgctcacgctggcctatgccttcgagccacgcggctgggtgttcggcggcggcctgtgccacctggtcttcttcctgcagccggtcaccgtctatgtgtcggtgttcacgctcaccaccatcgcagtggaccgctacgtcgtgctggtgcacccgctgaggcggcgcatctcgctgcgcctcagcgcctacgctgtgctggccatctgggcgctgtccgcggtgctggcgctgcccgccgccgtgcacacctatcacgtggagctcaagccgcacgacgtgcgcctctgcgaggagttctggggctcccaggagcgccagcgccagctctacgcctgggggctgctgctggtcacctacctgctccctctgctggtcatcctcctgtcttacgtccgggtgtcagtgaagctccgcaaccgcgtggtgccgggctgcgtgacccagagccaggccgactgggaccgcgctcggcgccggcgcaccttctgcttgctggtggtgatcgtggtggtgttcgccgtctgctggctgccgctgcacgtcttcaacctgctgcgggacctcgacccccacgccatcgacccttacgcctttgggctggtgcagctgctctgccactggctcgccatgagttcggcctgctacaaccccttcatctacgcctggctgcacgacagcttccgcgaggagctgcgcaaactgttggtcgcttggccccgcaagatagccccccatggccagaatatgaccgtcagcgtggtcatctgatgccacttagccaggccttggtcaaggagctccacttcaactggcctcctagggcaccactcgaggtcaatctggtgcttattctcagcaccagagctagctaagccaacatagggcaacatttccagcccagccctcttgtccggctgtctgtcttgtccttgtgtgtttgtaaaatgttaagcgggctttggtgagagtcttgctctttgcttgggggaggccaaagagagggaagaggatttcttatttcttctttatgcccttgaaggacaaacaaaactttttctccacgttcagaaaagtatttcagaaccacgattgccttcctggcgtcccctcctcctgctcgttggtgaaatgaacaatatgaatgggatttaaaaggaatgcattgggcttggtaaagattttcagtttgcctttagaaaaaggacccagctgagagtaccatgatattgcttagtccatttgaacccttgcattcctagaatttcaggtaaatatgtattaaaactctacatctaggatttcagcatttcctgagtaagacctttatatgccaaaagggtttcgttttaaaaccacttgagtttatagtacaaaaacacctacaagctccctttagaaaggtcttgctattgtttctcccctttcctccccaactactatttaaaaatgat

SEQ ID NO: 5092 - DNA, 2704 bp, Homo sapiens
gcgggaggcggttcctgcagggtccagtcccgggagcacccccaggaggaggggagggtgggagcgcctctctttgagtccccgggtttggtcgctgggatgtgaggaagccggagaggccgcggctggacgcaggtgggtgtggaggggccgcccggactgcggggacccgctccgcgcacagtggctgagcgcccgcctctctttccaggggctgaggatccggcggctcggctgcactatgcccttcccgcccatgccgccgccgcccgcccccgccccgggggcccaagccgcgcgccagttaccccggaggccctgcgccgcgggggacaagaagaagaggcccccacagcggcccgaggggctcctctccagctcctggccctccgccacgctcaagaggccgccggcccggcgcggccccggcctggacaggacgcagccgccggcccctccgggcgtctccccccaggccttgcccagccgcgcgcgggccccagccacgtgcgccccgccccggccggcaggctccggccacagcccagcgaggaccacctatgcggcgacctcggcggggacggggaccaccgccgcgggcacctcctcgggggcggggccttgtccagactccgctgcgcgcttctgcctgaatctcacccccgaggccgtcctggtcatccagaagcgtcatctggagaagcagctgctggcgcggccccgcaggcccttcccctcaccctcggccgaacccaggcgcctactcgccccgtgtctcccggctagggccgcgggcccgcggaggggcggccccgccagcgaccccgacgcaccccccaccgccggccagggccgccgcgcgcctccgcccggcgcccagctgctgcacggcggcctgcaggttccccagctcagcccgcggcccggggccctgcggccgatgctcaaggtgtcgctgctcaacgagcggcacaggtacgacgacgtggagtacgaggaggagccagaggcggtggacgagggcctggtacgcaagtgcacggagtggctgcgcggcgtggagtccgcggctgccgcgcggggccgggcgggggccctggactcacggcggcacctgagcacgctgtgagcccagcgggcctgcggggacaggccaggcctgatcccacctcacttcctgcacgcgccactccgcctaggggccctcgggggagaccgcaggctcctctggccgccagcgcccactttcgggacaccagtgcgcaagctggcccacgtggggcgcagccagactcgcccgacggccacggcccccctcctgccctcgccagccggcagcccgggcctttctcgttcacaccggtggtatctaccccagatgcctgcctctgcccccactctggcctcctcttggcatcgccgagcatccatgcagttcgtggggaattaagcaactgagaaaatgcctcttggtgccccgacccccagggttcgtctaggtcccagagaccctctgcctggaggcgggccttccccagggctacatctgcacgccccgtggtgtcaccctcagccggcgccgggcaccctggacagtgcggtgggcgatggcccaggtgggtggccgcgacggtggcctcctgcagagctgggacccggtcctacattcgtgattttgttttctcccaagtcagaaaaatgttgagggtattagacatccctgaaactcagttaaccgaatttccagtctccaaagcggaagggtaggcatcgccaggcgctggtgagccctggtcaatgagcgcttccatggaaaccgctcggctgattacattttttctgtgtattatttgaatagagagtaaagctcctccgctgtttcgtaaccatatcctttcccccgctaactggaggctgatttctacatatttcttccatgtatctgagaatatctaactagaaggatgagaaggaaataaaatgttataatcagataaggctggttataaaagagtaatgtattacctcaatttttgactgactttgtaaaagccaataactggtttaatgtttatcttgatagactttaaatgtatcaagtcttaattgtattttaaattgaagccttacatttttaaaacagattttgtatttttcttgtggaggtctttgctctaataacacacacacactgtctctctctctctctctctctaattctaggcacacatttagttagatgtgaagcatttaattcattgggagctaggtcagctgccagatgagttgcaaaaacagaaaaaaacctacccattgaataacttctttgaatttggagataagttttcttttacttaaaatgaatatattaattctagaggggcaaaactagcaatgcttatgcaagtgacggtgctgctcttgttccacccccacccagatggtctctgagtgcgccgtcctgggcagggcacacggtctggagctgagagggtggagcaagagtgcactgactccgagccgagggcaggagtggctcaacttggtctcgtcttgcacttagtgcaaataccaataattaagatgcctagacttctgcccttggtcacagtaacaacaacattttgaagacttttccctggtggcatcctagagggaccgactttctgcagcctctgtcttccaagctgagcttctgctgcag

SEQ ID NO: 5093 - DNA, 580 bp, Homo sapiens
gccggcccggcccgcgtctcagctgtggggacccgggggcgccgcgactcgcccacagtcggacggcgggaggcggttcctgcagggtccagtcccgggagcacccccaggaggaggggagggtgggagcgcctctctttgagtccccgggtttggtcgctgggatgtgaggaagccggagaggccgcggctggacgcaggggctgaggatccggcggctcggctgcactatgcccttcccgcccatgccgccgccgcccgcccccgccccgggggcccaagccgcgcgccagttaccccggaggccctgcgccgcgggggacaagaagaagaggcccccacagcggcccgaggggctcctctccagctcctggccctccgccacgctcaagaggccgccggcccggcgcggccccggcctggacaggacgcagccgccggcccctccgggcgtctccccccaggccttgcccagccgcgcgcgggccccagccacgtgcgccccgccccggccggcaggctccggccacagcccagcgaggaccacctatgcggcgacctcggcggggacggggaccac

SEQ ID NO: 5094 - DNA, 3808 bp, Homo sapiens
gcttggcagtttcccattgcggggcagctgggccgggggcgggggtcggctgcagatctcccgttgtgtgagagaaacgcaagcacggagctcccttgacctgctgcatcctcctcggcaattttttttttttaagtcaaaaagcttggatttcctgaaattgttgaactggatgcgcgcggagtctggggcggaggcgagcggcgggtgtgcgcgactcggggtgattcacgccggggaccccaaggaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatgtaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagagtttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcgtgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgtt

SEQ ID NO: 5095 - DNA, 3930 bp, Homo sapiens
ggggcagctgggccgggggcgggggtcggctgcagatctcccgttgtgtgagagaaacgcaagcacggagctcccttgacctgctgcatcctcctcggcaattttttttttttaagtcaaaaagcttggatttcctgaaattgttgaactggatgcgcgcggagtctggggcggaggcgagcggcgggtgtgcgcgactcggggtgattcacgccggggaccccaaggaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatgtaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagagtttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcgtgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgtta

SEQ ID NO: 5096 - DNA, 548 bp, Homo sapiens
agttgctgaaggggaggaggagtgagatggggtgaagcgcgcggagtctggggcggaggcgagcggcgggtgtgcgcgactcggggtgattcacgccggggaccccaaggagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagct

SEQ ID NO: 5097 - DNA, 783 bp, Homo sapiens
tttccctttaggccactcttgtcaatgctcccaacggcctcctccttcctccctgtgctgctctggggaggtctcttggctctgcccggcagtaggaacagtggagacaaagacagcttcacattctcttcagctgtcaggattgagagtggcggattcgggaggagaaaaatgagtcagtggcaactcgttgtgtgtgactgtgcagtttatctgagtccgcgggagccatagtcgtaggctgaaaatgacccttatttaagagaggctgagtgcgtggttgtggctgcccaggcgctttgctggactaggcagcctgggaacactaactgagaagtggacggggacaggagccagcctgcggtcctcagtgtcttacagtttcctggagaagtggatgtttcggcaggaagatggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacat

SEQ ID NO: 5098 - DNA, 805 bp, Homo sapiens
cgtaagatgagagaggagggaaacgtgtcaccagcccggctgtgggagctccgcggccgaagcgtttgttgactcgcgctggagaggaaccgaggctggacgggaccccatctgagggcagagctgggggaggagggagggacggagggagggagagctgggcagagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttt

SEQ ID NO: 5099 - DNA, 592 bp, Homo sapiens
accagagactcctgccttccattggcgaaccggtcaccggctccgtcctgaaaacagaacttgctccgagtgataagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgc

SEQ ID NO: 5100 - DNA, 544 bp, Homo sapiens
acatttattgtgcccaagacttttgtgggctctctgccaggaaagggcaggtcattgaatgggccctgggaaaaatgatgtctgagcttctctccagttctcagagaaagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgag

SEQ ID NO: 5101 - DNA, 554 bp, Homo sapiens
attttccttgaggccgccgcccggggtgggaccaggctgtgtgcttgctaactgtgcttcaggaatccgctctgggatgccttcctgtctggcaaaaggggttacccccagttctacccagtccctgtcctcggtcacatgctgccgccgcctcttcccccgcggtgccgggagcccgcgttttgtttgtcagcagttaggcggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatg

SEQ ID NO: 5102 - DNA, 577 bp, Homo sapiens
aacgtgtcaccagcccggctgtgggagctccgcggccgaagcgtttgttgactcgcgctggagaggaaccgaggctggacgggaccccatctgagggcagagctgggggaggagggagggacggagggagggagagctgggcagagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccag

SEQ ID NO: 5103 - DNA, 2291 bp, Homo sapiens
agtcttcaggccccaggtcagtgagtggcaagccaggcccagagatctctgcgcccgttggaacatccccttctcgggaggctggaaggccatggtcattcacctctccccagcaaggtgggacctgccctggaagaagaaaccagaccaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgttt

SEQ ID NO: 5104 - DNA, 572 bp, Homo sapiens
ggaacctggcactagaatgtgagcaaaaaagaggcaattctgctgacttcagagaagcttccttgcagaaggaatctgaaacacgagcaactctctggggaggatgagaagctcttctacaaggaggaggaaaacataccttaggctatatggctgctgggaatccaggttaaaatgtttaaccctggagaaaaagaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcgg

SEQ ID NO: 5105 - DNA, 740 bp, Homo sapiens
cgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagccaggcggcactccagggtccggcccaaggtgactgtcctgaactatgcctccccgataaccgcagtcagccggccactgaatgagatggtcttgacc

SEQ ID NO: 5106 - DNA, 1476 bp, Homo sapiens
gcgcgcgccccgcgcctccagcccagcgctcggagccgctttcgctgccactgtctgctcccccgggccgccgccgcctccccccgcaggcccggggctctgtccgctgggcccgcgctgctcgccccgagccaggagaacgagctcgaggaggatgcctgggcccggtgcaaggttccccctctcacccgcagctgtggagaggaggaagcggaactagagatgcccatctggagtgagtgcaggaccaggtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtgtgatctggtttggt

SEQ ID NO: 5107 - DNA, 926 bp, Homo sapiens
atggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcaccacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtgtgatctggtttggt

SEQ ID NO: 5108 - DNA, 1345 bp, Homo sapiens
gagccgctttcgctgccactgtctgctcccccgggccgccgccgcctccccccgcaggcccggggctctgtccgctgggcccgcgctgctcgccccgagccaggagaacgagctcgaggaggatgcctgggcccgtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtg

SEQ ID NO: 5109 - DNA, 993 bp, Homo sapiens
acggggacctggacatgtgtgtgctctccgagctgagctgtgtgcgcgtccgggttctcgacctcagctgcctggctgtgcatccagcgtgcacgaccggtgtggcctgggctccagcctggagtgtggaccgggtcggccggcgtgtgcctcccctgtgagggtgccctggcgggtgtgagcccggcgggctggagaaccgggtctcggcgccgcaggtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaa

SEQ ID NO: 5110 - DNA, 1285 bp, Homo sapiens
cctgctctgtgagacctgtgttgagtgctctgcatccattatctcctaatttttttttacaacagttgcgcaaggtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtg

SEQ ID NO: 5111 - DNA, 4699 bp, Homo sapiens
gcagccgcaggagcatgcgccgcccgtggccatcttgtaggcggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagacattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaaattatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaagaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttctttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttatttccaaa

SEQ ID NO: 5112 - DNA, 1541 bp, Homo sapiens
ggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgaatccccaaagagcagtggcagtccatggcttggttgaagctagaaattttcctgcccctggtgacctggtaagcctcctgctcggaaccgtgtga

SEQ ID NO: 5113 - DNA, 1079 bp, Homo sapiens
ggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggagctaataga

SEQ ID NO: 5114 - DNA, 5504 bp, Homo sapiens
ggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggttggttttctcctttgctttttcattatgctccagagaaacttacactattgttttcagaataaaaatttgttcggtttttttgttagaaatatgttcttgattttgtttcagtcatttttcttttagtatttttctttgctttttaatttcctgatccttccatgttgttttagtaccttcctccttttgttttccaggtgtctttgaaaggtaatacattacatggttaatcattatttctctcatttttttctttgtttttactctgagttctggaaaagatttaccttttctagttgttttatgtccgcctttcgtttgctttcccttttatctcacatttcatttccactgttatctccatttcccttttccttgattgattgtcctcctgttcatctttagtgaaatcaacattagaaaccttataggcacgtgtctttaggtttttggctgaaaaatggacctaatagtgtacctatccacacagtttccaggagaatgtaagtataaatgataatccttattcctctttttttttttttttggtgtgttttctctaatcctttcatgaacaaaatggaatataaatatatacttgcattggaatctctgtgctcttaagtggtattctattgacttttttctgtcaatttcataaaatttttgttacagttgtagtttgtacattgttaaatatcatttcaaaactgcctttcaaacttatttgggacatgaagacatttgagaatctaagaaaactattgggctgtctcccaagaaaaatgcgtgtatgtgtactttcatagaactttggcatatgtgttcacataatccctaaaagtaacctctggcctacttattacagtttagaaagggggctaagaattgatgcttggaatttgaaattttactgaaacttttatttataccgtaatttcttttcataagttcaagaaaacctttttatagatattaacattacactcatttcaatatgaaggtgattaaaagactgtaagtgaatactatgcatactgttatgccaataaattagaaaaattaggtgaaagagtggattttctaggaaaatagaagttttgccatagttaagagtattaggttgaaccaaatgacgttgttgcctttgatggtcagaaatagttatatattgtcagtttcatatgattcagcttaattgaagcattaaaatggaagaactttatgtaactaaaaaaaaaaaaatcactgagtaccaatggtgttacaagtgagttctacaaaatgttcagagatgatttgctgtatgaggtatcaaaaatagaggtagagagttttccagttcattctgtgagactagcctcttttaactttaaatgaaattatagtccaaagaactaaatgtcaaaaccattggtaaaattaataaataaaattcagaaatgtattagatgaacattgtatcctgaccatgaaaaatttgtcccaagaacagcagaatggttcaacaatagtaaatttatgtaattcagtacatgaacatctgcattgaaaggagaaaaaagattttgataagagttgaaggtatttgctagaaataatcatactaatagctcttagtattagacgggtatgtgtgtactacaaaatcaaagcaaacttcagatctaataaataaaacactgaaaacgttataattatgaggatgctcctgtcactgccactgttaacattgctgtagatctggggtcagcaaacagtggctcacagccaaatctggcctgtcatctttttgtaattaagtttattggaacacacccatgccagtttgcttacttattgtttatagctgcttttgtactatagcagcagaaatgaatagttgcaacagagaatgtctggcccacaaagcctaaaatatttaccatctggctcttttcagaaaaagtttgctgacccctgtgttagatatctgaccattgcaaaggacaatttttatgttgtttttaggaatatatactggaaagaagtagacatgaaagaatgaagtggactcgtgtgtaccagtaccaaaagatagctattacatattgctgagtaaaagtcaaaaacagcacatctagtatgatcccatttactagcaggcgtgtgtatgtgtgtgctttaaaattttaataagaatagggaaaaaggcctggaaagataacacagcaaactgttaatagtggttaattctgaataatggtatttaaagggtgttatttgctttttactttgctttttattctgtttgttttattttgtgtcatttggttttaaaatttagaagatacaaaactgtgtgcattgaaatgtcttctttttatcctcagctattcagctctcctccctgtttctttttattcattctaaaatgttttatgcttttttattgttggaattttttaatttaaggtaatggaaatcagcccttcaggtaattagaattatcagtatatattagtaaaaatctggaaataaatttcatacaatttgtacttgttaaacttaaatataaatgattcctcacccccataaaaaaccccagctgttctggatttttgccaataatatagaataccttgtttctaaaaagtgtggtccttggcttaacatcataagcagcacctagaaatttgttaaaatgcagattctcgggtcctaacacaggactagtgaatcaggagctgcattttaacaagatattcaggggattcataggcatgccataatttgagaagcacagtgttactggtgtctctgaggacgttagtagtatatctgctgtttctctttgaaatatagtgaaatactgatactgtagtatacacattggaagagagtacttagagcaggggttcccaagtgctggactgtttgcatcagattgacttggaagctattttacgtacgtaatactgtactgtttctcttggaaccagctgtagagtttccaattcagttatcttggtgtctcagttatcttagtgggatgtgagaaactggatatcgttaaaaaagaaaaaagaaacaagagctcctcaggtgattgtaatacatggcacatttggtagtcatgtataactgtatagatccgttctagatgtggctatacttctctggactatacctaacaccctaaaacagaaaaaccacatcagtcttggatatcaagcaatgagtttattcttctgtcattcctttgtagatgaataaatgatttgaataggagcaaatatgagttgggtcaattaggaatgttgcatcagtggttgatgttgtccaggactggatattacttgatacatattaacatgtgaatcacatttccagagagaatttccataattgagcaattcttttctgaatggatttaagccttaattttcagttttcctctttctggttgaaattttactactataaaagataactttagcactgattttagtaccaatcttattattaacctgaagtgacacttaatttagaactagaactcaaaccttccgactgttagcctcgttaatggggatattttttaaaaaatagatgtgtgtaatgttacattgattgtgttctagccttgtaagttgatatagttggcagcctagctgtatttctcagagtttgtcataatctatatttaaaataacatgaaacactttgaaatgtcacttatagctagttccaatgatatttttaaatgtattataagtaatatcaatttcatctttccacaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaa

SEQ ID NO: 5115 - DNA, 2719 bp, Homo sapiens
cacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcggaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttatttccaaag

SEQ ID NO: 5116 - DNA, 2726 bp, Homo sapiens
cacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcggatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgactta

SEQ ID NO: 5117 - DNA, 1909 bp, Homo sapiens
cgccgctgccttcatctctccatctctgcgctgctgccggctgcgccatccagcacccagactccagcaccggccgaggacccccactccggctgcagggaccctgtcccagcgagaccgcaggcatgtcatccgaaaagtcaggactcccagactcagtccctcacacttctccgccgccctacaatgcccctcagcctccagccgaacccccagccccaccgccacaggcagccccttcctcacaccatcaccaccaccaccactaccatcagtctggcaccgccaccctcccgcgcttaggggcagggggcctggcctcttccgcggccaccgctcagcgcggtccctcctcctctgccacgctgccgaggcccccccaccacgcccctcccggccctgctgccggggcacccccacccggctgcgctaccttgccccgcatgccacccgacccttacctgcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgattta

SEQ ID NO: 5118 - DNA, 1726 bp, Homo sapiens
atctgactctgtggagcctgggactggtttcagcgagagcctctgtactgctctgtagtctctgctaggacatggacgaaaagggacgcagccgggagagcgactgccccagtcccacccgcctcgcctggtctagcctccgtgtttccatgacaactccaaaggaacccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgattta

SEQ ID NO: 5119 - DNA, 1536 bp, Homo sapiens
atgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttg

SEQ ID NO: 5120 - DNA, 1726 bp, Homo sapiens
atctgactctgtggagcctgggactggtttcagcgagagcctctgtactgctctgtagtctctgctaggacatggacgaaaagggacgcagccgggagagcgactgccccagtcccacccgcctcgcctggtctagcctccgtgtttccatgacaactccaaaggagcccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgattta

SEQ ID NO: 5121 - DNA, 1909 bp, Homo sapiens; identical to SEQ ID NO: 5117

SEQ ID NO: 5122 - DNA, 1726 bp, Homo sapiens; identical to SEQ ID NO: 5120

SEQ ID NO: 5123 - DNA, 1909 bp, Homo sapiens; identical to SEQ ID NO: 5117

SEQ ID NO: 5124 - DNA, 497 bp, Homo sapiens
agcgttcgggggacttgttctctaggtccaggatcttcctaatgcatcgcctcagccatgaacaacgcggagttctttaatacccgtgagcagcagcccaggccccttgaagagtgcagactcccacctggcctgggcgtctggctccgcagcagaacacgaagtttgcattccccaaggggcggccagggggcggaccagggaaaggtagtcctctgcattttgccgtgtgctggtcccacccgcctcgcctggtctagcctccgtgtttccatgacaactccaaaggagcccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccc

SEQ ID NO: 5125 - DNA, 497 bp, Homo sapiens; identical to SEQ ID NO: 5124

SEQ ID NO: 5126 - DNA, 1726 bp, Homo sapiens; identical to SEQ ID NO: 5120

SEQ ID NO: 5127 - DNA, 497 bp, Homo sapiens; identical to SEQ ID NO: 5124

SEQ ID NO: 5128 - DNA, 1726 bp, Homo sapiens; identical to SEQ ID NO: 5120

SEQ ID NO: 5129 - DNA, 497 bp, Homo sapiens
agcgttcgggggacttgttctctaggtccaggatcttcctaatgcatcgcctcagccatgaacaacgcggagttctttaatacccgtgagcagcagcccaggccccttgaagagtgcagactcccacctggcctgggcgtctggctccgcagcagaacacgaagtttgcattccccaaggggcggccagggggcggaccagggaaaggtagtcctctgcattttgccgtgtgctggtcccacccgcctcgcctggtctagcctccgtgtttccatgacaactccaaaggaacccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccc

SEQ ID NO: 5130 - DNA, 497 bp, Homo sapiens; identical to SEQ ID NO: 5124

SEQ ID NO: 5131 - DNA, 497 bp, Homo sapiens; identical to SEQ ID NO: 5124

SEQ ID NO: 5132 - DNA, 1726 bp, Homo sapiens; identical to SEQ ID NO: 5120

SEQ ID NO: 5133 - DNA, 497 bp, Homo sapiens
agcgttcgggggacttgttctctaggtccaggatcttcctaatgcatcgcctcagccatgaacaacgcggagttctttaatacccgtgagcagcagcccaggccccttgaagagtgcagactcccacctggcctgggcgtctggctccgcagcaggacacgaagtttgcattccccaaggggcggccagggggcggaccagggaaaggtagtcctctgcattttgccgtgtgctggtcccacccgcctcgcctggtctagcctccgtgtttccatgacaactccaaaggagcccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccc

SEQ ID NO: 5134 - DNA, 1909 bp, Homo sapiens; identical to SEQ ID NO: 5117

SEQ ID NO: 5135 - DNA, 1726 bp, Homo sapiens; identical to SEQ ID NO: 5120

SEQ ID NO: 5136 - DNA, 1909 bp, Homo sapiens; identical to SEQ ID NO: 5117

SEQ ID NO: 5137 - DNA, 1726 bp, Homo sapiens; identical to SEQ ID NO: 5120

SEQ ID NO: 5138 - DNA, 1909 bp, Homo sapiens; identical to SEQ ID NO: 5117

SEQ ID NO: 5139 - DNA, 1909 bp, Homo sapiens; identical to SEQ ID NO: 5117

SEQ ID NO: 5140 - DNA, 497 bp, Homo sapiens; identical to SEQ ID NO: 5133

SEQ ID NO: 5141 - DNA, 1909 bp, Homo sapiens; identical to SEQ ID NO: 5117

SEQ ID NO: 5142 - DNA, 1536 bp, Homo sapiens; identical to SEQ ID NO: 5119

SEQ ID NO: 5143 - DNA, 1536 bp, Homo sapiens; identical to SEQ ID NO: 5119

SEQ ID NO: 5144 - DNA, 1536 bp, Homo sapiens; identical to SEQ ID NO: 5119

SEQ ID NO: 5145 - DNA, 1536 bp, Homo sapiens; identical to SEQ ID NO: 5119

SEQ ID NO: 5146 - DNA, 1536 bp, Homo sapiens; identical to SEQ ID NO: 5119

SEQ ID NO: 5147 - DNA, 1536 bp, Homo sapiens; identical to SEQ ID NO: 5119

SEQ ID NO: 5148 - DNA, 1536 bp, Homo sapiens; identical to SEQ ID NO: 5119

SEQ ID NO: 5149 - DNA, 3368 bp, Homo sapiens
gcgatcggctgcagggacgcgcgcaaggtgaacacgggggctgcggcgcgcaggctcatccagtgaggactggaaggtgggggctttaggcccaggcatcggagtagaccatggcctccagcccatggggctgtgtatgtggccttctgctgttgctgctgccactcctggggactggccctgccctggggaggggctttcccaggccacttgaaaactccgaaatccctatgatccctggagcccaccccaagggctctgtgggctcagagccccaggcctttgacgtgttcccggagaaccccagagctgacagtcacaggaactctgatgtccgccacgcccctgctgaagagatgcctgagaagcctgtagcctctccccttggcccagccctgtacgggcccaaagcagcacaaggagctcagagagaacgactcccagtaactgatgacctccagatggctcaaggaccaagctcccacggctggacaggacctctggactcacaagagcttctgcagcaagaagcagtggctccccacccagtgggccaccctcatctcactttcatccccacaactcccagacgtcaactcagggtagccacagttcctccctccctgcagcatgaaggccaagagggacagtggccacctagagatgagggtctgaaggccaaaactaagagcagggtcccacccacttctccctcagaccaccagggcccaccccacacccttgtttcccactcaggtactgtcaagaggccagtgctggaaggacagggtgggtttgaggaacacttgcaggaggcagctcaaggtccccacttcacccagcaggatccagcagcccctgatgttggctcagtacccccagttgaggtggtgtactctcaggagccaggggcccagccagacttggcattggccagaagccttcctcctgctgaggagctgccggttgagacccccaagagggctggcgctgaggtgtcctgggaagtcagctccccaggtcccccgcccaagcaggctgaccttcctgacgctaaggattcaccaggaccccagcccacggatccacccgcctcagaggctcctgatcggccgtctaagccagagagagcagcaatgaatggagcagaccccatctccccccagcgggtgagaggagctgtggaggccccaggcacccccaagtctctcatccctggtccctcagaccctggcccagctgtaaaccgaacagagagccccatgggggccctgcagccagatgaagccgaggagtggccggggcgcccccaaagccatcccccagcacccccagtccaggccccctcgacgtcacgccggggcctcattcgagtcaccacgcagcgagccctgggccagcctccccctccggagcccaccgccagctccatggcttcagccccagcctccagccccccagccaacgccactgcacccccgctacgctggggcccccttcggcgggtcctgagcttctcctgggagctgcacgtctacggggtgggggtactctttctgctgcccgcgttgttggcgctggctgcgctggcagccgccccagcagggccccggctggcattggtggccgcggtgctggtgctcgtggcttcggcgctgcgatccgcctacatgcttaccgacccttacggctcgcaggcgcggctgggcgttcgcgggggcctggtgctctacaacctgcccttccccttgctgcttacggcgctggcagccctgactctgctcggcctgggcgcggggctgccgccaccgctgcaaaacccactcctgctgggagcagtggcgctggtgcatggtgtagggttgctcgcgacagacctgctgtccacatggtctgtgctcaacctcctgacgcagggcttgtcgtgcgcctggggcgcggccgtggctctgggcacgctctgcctgtgccgtcgccgcctgctggacggcccacggggctgggatgccagcccgggccctcggctgttggctgtggcgggcgcgctggggctgctggctagcggcttgcagctggcggctgcgctctggctgtacccgggcccaggccgcgtgggccgcttctcgtgggcctggtggggtgtccacttctggctgcgcctcctggagctgacatgggcgctcgccctggcgttggccgcggtggctgccgcgagacccaggccgcccacggagcacgcttgctgggctaagctgatgcgtctggcgtgcccggcgccgtcaggaaagagcgaggtgccggagcgacccaataactgctatgcagggcccagcaacgttggtgcaggcagcttggacatcagcaagagcctcatccgcaacccggcggagagtgggcagctggccacgcccagttcaggcgcctggggctcggctgcgtcgttgggtcgcggaccccagggtggcccgggactgtcccgcaacggtgtgggaccggcgccatcgctgagcgagctggatctgcggccgccatcgcccatcaacctgagccgcagcatcgacgccgcgctcttccgcgagcacctagtgcgagacagtgtgttccagcgctgcggcctccgcggcctggcctccccgccgcctggaggcgctctgcggccgcgccggggcagccatcccaaagccgagctcgacgacgctggctcctcgctcctccgcggccgctgcaggtcgctcagcgacgtgcgcgtgcgcgggccggtcccacagcacgtagtggaagcacccgacggggcagccgctgcggcttctggcagctccctcgacagcttctccaggggttcactcaagatcagttggaacccctggcgccacgggctgtcatcagtggacagtctgcccctagatgagttgcccagcacggtacagctactgcctgccccgaccccagcccctgattctaccgccgctcggcagggggacggccagggagaggtccagccgcgcggcaagcctggggaatcccgcagcgcctccagtgataccatcgagctttgaagagcggtcctgacgcagggccaggaccctgcccgatgcccacatggcatggcctactgggacagttgagcctttaaaaaatgggcatcctggccaggcgcggtggctcacgccaggaatcccagcactttgggaggccgagccggcattttgcacagaggccgtgtcttatgcggaatacagggtgggtgtgcatggattcgggcatgaagaacagggagcaggtgccccagactccccaacgtggagtgatgagcctcgcttgtctagattgtcctctttgtgccaaagaaataaacccttaggacttgg

SEQ ID NO: 5150 - DNA, 3761 bp, Homo sapiens
atctcggaggatgcggcgcggcgatcggctgcagggacgcgcgcaaggtgaacacgggggctgcggcgcgcaggctcatccagtgaggactggaaggtgggggctttaggcccaggcatcggagtagaccatggcctccagcccatggggctgtgtatgtggccttctgctgttgctgctgccactcctggggactggccctgccctggggaggggctttcccaggccacttgaaaactccgaaatccctatgatccctggagcccaccccaagggctctgtgggctcagagccccaggcctttgacgtgttcccggagaaccccagagctgacagtcacaggaactctgatgtccgccacgcccctgctgaagagatgcctgagaagcctgtagcctctccccttggcccagccctgtacgggcccaaagcagcacaaggagctcagagagaacgactcccagtaactgatgacctccagatggctcaaggaccaagctcccacggctggacaggacctctggactcacaagagcttctgcagcaagaagcagtggctccccacccagtgggccaccctcatctcactttcatccccacaactcccagacgtcaactcagggtagccacagttcctccctccctgcagcatgaaggccaagagggacagtggccacctagagatgagggtctgaaggccaaaactaagagcagggtcccacccacttctccctcagaccaccagggcccaccccacacccttgtttcccactcaggtactgtcaagaggccagtgctggaaggacagggtgggtttgaggaacacttgcaggaggcagctcaaggtccccacttcacccagcaggatccagcagcccctgatgttggctcagtacccccagttgaggtggtgtactctcaggagccaggggcccagccagacttggcattggccagaagccttcctcctgctgaggagctgccggttgagacccccaagagggctggcgctgaggtgtcctgggaagtcagctccccaggtcccccgcccaagcaggctgaccttcctgacgctaaggattcaccaggaccccagcccacggatccacccgcctcagaggctcctgatcggccgtctaagccagagagagcagcaatgaatggagcagaccccatctccccccagcgggtgagaggagctgtggaggccccaggcacccccaagtctctcatccctggtccctcagaccctggcccagctgtaaaccgaacagagagccccatgggggccctgcagccagatgaagccgaggagtggccggggcgcccccaaagccatcccccagcacccccagtccaggccccctcgacgtcacgccggggcctcattcgagtcaccacgcagcgagccctgggccagcctccccctccggagcccaccgccagctccatggcttcagccccagcctccagccccccagccaacgccactgcacccccgctacgctggggcccccttcggcgggtcctgagcttctcctgggagctgcacgtctacggggtgggggtactctttctgctgcccgcgttgttggcgctggctgcgctggcagccgccccagcagggccccggctggcattggtggccgcggtgctggtgctcgtggcttcggcgctgcgatccgcctacatgcttaccgacccttacggctcgcaggcgcggctgggcgttcgcgggggcctggtgctctacaacctgcccttccccttgctgcttacggcgctggcagccctgactctgctcggcctgggcgcggggctgccgccaccgctgcaaaacccactcctgctgggagcagtggcgctggtgcatggtgtagggttgctcgcgacagacctgctgtccacatggtctgtgctcaacctcctgacgcagggcttgtcgtgcgcctggggcgcggccgtggctctgggcacgctctgcctgtgccgtcgccgcctgctggacggcccacggggctgggatgccagcccgggccctcggctgttggctgtggcgggcgcgctggggctgctggctagcggcttgcagctggcggctgcgctctggctgtacccgggcccaggccgcgtgggccgcttctcgtgggcctggtggggtgtccacttctggctgcgcctcctggagctgacatgggcgctcgccctggcgttggccgcggtggctgccgcgagacccaggccgcccacggagcacgcttgctgggctaagctgatgcgtctggcgtgcccggcgccgtcaggaaagagcgaggtgccggagcgacccaataactgctatgcagggcccagcaacgttggtgcaggcagcttggacatcagcaagagcctcatccgcaacccggcggagagtgggcagctggccacgcccagttcaggcgcctggggctcggctgcgtcgttgggtcgcggaccccagggtggcccgggactgtcccgcaacggtgtgggaccggcgccatcgctgagcgagctggatctgcggccgccatcgcccatcaacctgagccgcagcatcgacgccgcgctcttccgcgagcacctagtgcgagacagtgtgttccagcgctgcggcctccgcggcctggcctccccgccgcctggaggcgctctgcggccgcgccggggcagccatcccaaagccgagctcgacgacgctggctcctcgctcctccgcggccgctgcaggtcgctcagcgacgtgcgcgtgcgcgggccggtcccacagcacgtagtggaagcacccgacggggcagccgctgcggcttctggcagctccctcgacagcttctccaggggttcactcaagatcagttggaacccctggcgccacgggctgtcatcagtggacagtctgcccctagatgagttgcccagcacggtacagctactgcctgccccgaccccagcccctgattctaccgccgctcggcagggggacggccagggagaggtccagccgcgcggcaagcctggggaatcccgcagcgcctccagtgataccatcgagctttgaagagcggtcctgacgcagggccaggaccctgcccgatgcccacatggcatggcctactgggacagttgagcctttaaaaaatgggcatcctggccaggcgcggtggctcacgccaggaatcccagcactttgggaggccgaggtgggtggaacacgaggtcaggagttcgagatcagcctcctggtctcgaacatagcgaaaccctcgtctctactaaaaatacaaaaaaattagccaggtggcacacgcctgtagtcccagctactcgggaggctgaggcgggagaattgcttgaacagggaggcagaggttgcagtgagccgagaccacgccattgcactccagcctgggtgacaagagtgagactccgtctcaaaaaaaaaaaaaaaaaaaaaaaaaaaaaaggcatccccaggcctctctacctgacggcaacccccgggggacagccaggtttgaactcaccccacccccatgccgttttttgcttttaatatttctatttttttttcagccggcattttgcacagaggccgtgtcttatgcggaatacagggtgggtgtgcatggattcgggcatgaagaacagggagcaggtgccccagactccccaacgtggagtgatgagcctcgcttgtctagattgtcctctttgtgccaaagaaataaacccttaggacttgg

SEQ ID NO: 5151 - DNA, 2279 bp, Homo sapiens
cggctgccgcggagccccggcgcgggcggcttcgccggggagcgaggctcggagccaggaggcggcgccgctgggagggagcgcggagtgcggagtgcggagcgcggggcctggccgcccgcctggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacgggggctatgaggtgctgcacgccctgggctacggcggccaatccggcctggaagggccctggccctggtgggccttccagctaggcctgcgcctgggcgaggtgggcgtcgcgctcccgttggcgctgctgggcctctacccggcgctctgcagtcctcgcgtgccgccgcgctgctgggccaagctcttccgcttgtccccgggccacgcggctccgctgctgccgggaggctgggtcactgggcccccagacaaggagcccctggggagcgccatcgctcgcggggacgcggagctgctgcagctgtgcgcgctggcagggccaggcccagacctcctactccagggcggaggttgccggggcttcgaaggcgcggcggccaacccggccccgtccccggcttcctctccctgcagcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtga

SEQ ID NO: 5152 - DNA, 3544 bp, Homo sapiens
cggctgccgcggagccccggcgcgggcggcttcgccggggagcgaggctcggagccaggaggcggcgccgctgggagggagcgcggagtgcggagtgcggagcgcggggcctggccgcccgcctgagagaagcggtgagataccacgaagcgttgcccagctgggcgccagggccgccacgaccgccccttttcggaggctcggcgaggagacctgcctgcgggagagaccccggggagcaggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcggtgcccgcccggcgccccctgcctggcgctgctggacctgctgctgctgtcggccgggaccacgcgggccttcccgctcttctacgacgcctatgggcacagggatcgactgcccgcgctcgcctggctgctgctgcaggaccttccgctgccctgcttggctgccggcctggggctggcctgcctgctgctggcccggccgcgcccgccgcggtgccccaccggcctggctgcgctgctgctcctggggctggggctggcggccgccgccgccctcgggagcgccgcgcatcgcccgctgcggcccctgcggctcgcctcgcgcgggctgcacgcctttctcgccgctttcctttccgggctgctgctggcgctctcctgctggggcgggcggcggcggcgggccggggcgcccctgggagggtcgggcttcaagggcgccacacccctgccgcaggggcgcagccccttcgcccctcgggagtcctggcggcgcgcggcgcgcacggccccggtggcgggcaccttcgggctgctgagcggagccctgcagggctatgaggtgctgcacgccctgggctacggcggccaatccggcctggaagggccctggccctggtgggccttccagctaggcctgcgcctgggcgaggtgggcgtcgcgctcccgttggcgctgctgggcctctacccggcgctctgcagtcctcgcgtgccgccgcgctgctgggccaagctcttccgcttgtccccgggccacgcggctccgctgctgccgggaggctgggtcactgggcccccagacaaggagcccctggggagcgccatcgctcgcggggacgcggagctgctgcagctgtgcgcgctggcagggccaggcccagacctcctactccagggcggaggttgccggggcttcgaaggcgcggcggccaacccggccccgtccccggcttcctctccctgcagcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtgaagaggtggccaccttgctaccctgcgatatgcccctttctggcgcctgccctgcccgagacctgcacactgtaatccttccccaatcctccctggctcagatacctctccagattccttccccatccaggggtccctgggtgggtgggtcagcagccaggctctatcgattgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggcccccctacccacctctgccatgcctaggaatcccacccctgtgtgaatgggactccctttcctccatgtgacacccacaggggtccatgacccatctaggagactttatagcagttgggtgggaggggaatgctcttaatttatcaataaaatattttcagagg

SEQ ID NO: 5153 - DNA, 2897 bp, Homo sapiens
cggctgccgcggagccccggcgcgggcggcttcgccggggagcgaggctcggagccaggaggcggcgccgctgggagggagcgcggagtgcggagtgcggagcgcggggcctggccgcccgcctggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcggtgcccgcccggcgccccctgcctggcgctgctggacctgctgctgctgtcggccgggaccacgcgggccttcccgctcttctacgacgcctatgggcacagggatcgactgcccgcgctcgcctggctgctgctgcaggaccttccgctgccctgcttggctgccggcctggggctggcctgcctgctgctggcccggccgcgcccgccgcggtgccccaccggcctggctgcgctgctgctcctggggctggggctggcggccgccgccgccctcgggagcgccgcgcatcgcccgctgcggcccctgcggctcgcctcgcgcgggctgcacgcctttctcgccgctttcctttccgggctgctgctggcgctctcctgctggggcgggcggcggcggcgggccggggcgcccctgggagggtcgggcttcaagggcgccacacccctgccgcaggggcgcagccccttcgcccctcgggagtcctggcggcgcgcggcgcgcacggccccggtggcgggcaccttcgggctgctgagcggagccctgcagggctatgaggtgctgcacgccctgggctacggcggccaatccggcctggaagggccctggccctggtgggccttccagctaggcctgcgcctgggcgaggtgggcgtcgcgctcccgttggcgctgctgggcctctacccggcgctctgcagtcctcgcgtgccgccgcgctgctgggccaagctcttccgcttgtccccgggccacgcggctccgctgctgccgggaggctgggtcactgggcccccagacaaggagcccctggggagcgccatcgctcgcggggacgcggagctgctgcagctgtgcgcgctggcagggccaggcccagacctcctactccagggcggaggttgccggggcttcgaaggcgcggcggccaacccggccccgtccccggcttcctctccctgcagcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtga

SEQ ID NO: 5154 - DNA, 2313 bp, Homo sapiens
cgcggagtgcggagtgcggagcgcggggcctggccgcccgcctggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacgggcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtgaagaggtggccaccttgctaccctgcgatatgcccctttctggcgcctgccctgcccgagacctgcacactgtaatccttccccaatcctccctggctcagatacctctccagattccttccccatccaggggtccctgggtgggtgggtcagcagccaggctctatcgattgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggcccccctacccacctctgccatgcctaggaatcccacccctgtgtgaatgggactccctttcctccatgtgacacccacaggggtccatgacccatctaggagactttatagcagttgggtgggaggggaatgctcttaatttatcaataaaatattttcagagga

SEQ ID NO: 5155 - DNA, 2268 bp, Homo sapiens
gatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcagcgcgggcacccccgcggcccctcccctgggcgcgcgcgcgacctgggtgccatggcggcagcggcggtgacaggccagcggcctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 5156 - DNA, 2127 bp, Homo sapiens
gacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcagcgcgggcacccccgcggcccctcccctgggcgcgcgcgcgacctgggtgccatggcggcagcggcggtgacaggccagcggcctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggcccgacaaactccgggtcggcgaaacagag

SEQ ID NO: 5157 - DNA, 4649 bp, Homo sapiens
gatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggcttgtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaacaattctgccactcgcaatctctcctttcctctgtctccccaaagccactgcatgctgctgagtggctcctttttcccttcggtccccaagattcactctcctgttctatggcctgtttcctctgaaagaatctgactgtcctggaatcttggcacatgaagggtccttcagaggacggcagccaggaacacatacaagcccgagatgcctgcctgtcccctgcgcagatctgaaaccataacaaaagtgaccagggcaaatcaaactctgccagccaggcctgagaaaagattgattttttttttttttttttgagttccaaccccaaaaatattccaggacaagatagggggcaggctgggctggttcttcttcaatgggcttttgccgccaaggaggacagtggacttggcccacatccaggctacccccagcccgcttctcccctgcttagcccagggaggagacagtagaggtgatgggggcagccgggagggaggggccaaggcagtgatgctttcgggtaagaagttgggctgaggctgggggcacagggaggagctgcccaggtgcagttaccattgctcagtgacagagcctcaaagcttggccagggctgaaggtaccacacgggtgtgggtgaggcaggctaagcgggatggctgcagccaaggagctgggggagggccgggctcagggctagccctctccgctctaactgatgatctgccgaggtc

SEQ ID NO: 5158 - DNA, 553 bp, Homo sapiens
ataatgtgggtgctaatgaggagaggggcacattgcacggagcgatcgaggccgacggagggagaatcgggaaactgacccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatc

SEQ ID NO: 5159 - DNA, 583 bp, Homo sapiens
gatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagct

SEQ ID NO: 5160 - DNA, 549 bp, Homo sapiens
gaagccgcgagtttccgcagggaggcggcggcagctgcggcggggccgagccgcttgggtgtgtatctgagtactaagccctgccccagggtggacccagtggagagcaaaggcttttaaaggagcccagccaccataggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttca

SEQ ID NO: 5161 - DNA, 3169 bp, Homo sapiens
atctttgtggtagccagtggcaacggaggccaacacaacgacaactgcaactacgatggctacgccaactccatctacaccgtcaccataggtagtcacccaatgtttctgtgctcctgtgtgtgtgtcaccgaagggttagggcatcacacgtcttgtcctagcttctgtgtgtgtctaaatgtgtgagcacaataatctctttgggctcagataggactagccctgcttgcagaggaccttgggacttcttagatgtcagcataccctgggaacaccttcaagccatcatctggagatcaccgagctgcctccaccccaccacagctggttaggcctctgctctggcctgtctttctgtgggccaccttctgcctgctggaagcctcccctgactccccacaggcctaaattaagtgccctttgcctgtgctcccagttagcatgtgtttatttacttacctgacttctacctgactctaggctcctcgagactaggactgcggccttttccatatggccctgatgcctggcacgggtgtgacccacagtagatgggtaatgaatgttgaaaacagtaagcatgtgaatgaataagtgggtatgaaggtagaaggctgccagttgtaccccagagcctactgaaagaatggtattgcggcacagaatgccctctgccacttgagactgcctgttcagaagaggatcaggactgctctgagggacgtgggccgctcagatcatgtttcaaactcaggacagccccccaggatggtaactccaagataactgacattagcaagcccctgccacaggaccccctctgcatctcagctctaatctccctcctctgtccctaggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggcttgtcatcagggatgtcggatagcaacaaaaagtccttgtcgaaaccacatttcaagtccttttacgtataaccatccttcggccagccccggtaggcaggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaac

SEQ ID NO: 5162 - DNA, 3264 bp, Homo sapiens
cagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttcc

SEQ ID NO: 5163 - DNA, 5257 bp, Homo sapiens
cgcttgtgggccggccttgggggagggggacgcgcacccacagaaggactcagagggcttcacggtaagctgagcagggtcaaggtccacagggagcgggagagggtagtaatccgggaagtcttcctggtggcagtgaattctttgcggggttcggcaggcgcaggatccttggggccgcgcaccctgcagcggcccctcccctcccctcccccctcccacctgtgggaaacgcaggccctgagagaggctccgtcagtgccagcagctggcgccactgcgtcccctgccccggcctcagccagccctgggacctctgcggaggactgatcccgggaagggggccctgtcttcccagggccccggtgcggccgagctgggaagaccttggggagggcaggcctgccacctactgcagccgcggcccccgtccatccgggagggacaggctgtgcccttggcggcgcccacccgcgacccagatgtgcgtcgcctacccaccctcccccagacccccgtttcctcaggcgctcgccgcctcggggcgcctggcacgcggcagccccgcaaggtaggtccttcattcctcccatttcgcagaggagaaaactgcagtccgggatggctcagtcggcccctccaaagtcgcgcagctggttcgggccgagccccgactgcgagagtgaggcacatggcccctgcagaccgggcctcggagggtcccaggcttgaggacccgtcggcccctcaaccccttggaaaggcaaggagagaagcctgcgctggtagtgagcttccacttctgccctgactgcaacacttaggttagggggctgggaaggacccccaccctcaatttttggataggggtgtatttctctccctcccctaatttctgaggttggttccctgttggattcaggtactgctctccccttccaaccccatttccccagcccatgaggttgggatattagggtcccagacccaagataaagaaccccaaaattctggggttgcagcaaagagttgagagggtcactgagcctgggaagctcatggcggaggtggggctaaggcagaagtttaggaatggaacgctgagctgagctgagctgagctgagctgagcaacgctgggggctatgtgcatggagccctgggggttgggctttatcaggtgggcaacaggcagcccccattcccaagttctctcttttatcccagccttattccttcaccttggatgcctgggaactttttgtacccattgtagggaaggggacactgaggggcagagcggtgccgggttgacttggctggggtggtgggaataggagtagggtcttacctatctctgccttcccacctgtgcccacagtgcccccctggcttagtcatggcgaagctggagacgctgcctgtgcgcgctgacccagggcgggatcctctcctggcctttgccccacggccctccgagcttggacccccggacccccgcctggccatgggcagcgtgggcagtggggtggcccatgcccaggagtttgccatgaagagcgtgggtacccgcacagggggtgggggcagccagggcagtttccctggcccccgaggcagtggcagtggggccagcagggagaggccgggccgctacccctcagaggacaagggtctcgccaactccctctacctcaatggtgagctgcggggcagtgaccacaccgatgtctgtggcaacgtggttggcagcagcggaggcagcagcagcagtggtggcagtgacaaagccccaccgcagtatcgtgagcccagccacccacccaagctcctggccacctctggcaagctagaccagtgctcagaaccactagttcggccgtcggccttcaagcctgtcgtacccaagaatttccactccatgcagaatttgtgccccccgcagaccaatgggactcctgagggacggcagggccctggtggcctcaaaggcggactggacaagtctcggaccatgactccagcgggtgggagtgggagtggcctctcagactcaggccggaactccctcacaagcctgcccacctacagctccagctacagccagcacctggcacccctcagtgcctccaccagccacattaaccgcattggcactgccagctatggtagtggtagtggcggcagcagcggtggggggtcgggctaccaggacctggggacctccgatagtggacgggcctccagcaagagtgggtcgtcgtcatctatggggcggccaggccacctgggctctggggagggcggaggtggaggcctgcctttcgcggcctgctcaccgccctcccccagtgcactcatccaggagctggaggagcggctgtgggagaaggagcaggaggtggcagctctgcggcgcagcctggagcagagcgaggcggctgtggcccaggtactggaggagcggcagaaggcgtgggagcgggagctggccgagctgcggcagggctgcagcgggaagctacagcaggtggcccgacgtgcccagcgcgcccagcagggcctacagctgcaggtgttgcggctgcagcaggacaagaagcagctgcaggaggaggcggcccggctgatgcggcagcgggaagagctggaggacaaggtggccgcctgccagaaggagcaggccgacttcctgccccggatagaggaaactaagtgggaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtgtggctggaggagaaggagaaggtgatcgagtaccagaagcagctgcagctgagctacgtggagatgtaccagcgcaaccagcagctggagcgcaggctgcgggagcgcggggccgcagggggtgcaagcacgcccactccccagcatggcgaggagaagaaggcctggaccccctcccgcctcgagcgcattgagtccacagaaatctgatcgacctgggcactcggcattttgacacatgtcctgtcaaaaggccagagtccccagtgtcccctcccctccatctctcttccccatagaccccataaccccagaccaaagaggttctctaagcagctgtgaccaggttcctccctccccacctgccctcctagctccagcactgcccccgtggcagcccacttggacccccctaaaaggagggaataggaggagggcagggtgagtgggggcaatcctaggtggtgggggagtcatgctccctttctcggcacccccttgttggagatggaggcagcagacgtgcagtgccataaggtgccccagtccttctggaggcctgggctgctactgttggccaccctgtgtctagtgatgctctctgtgctcacctcctaggccatggagcctgagggggcctgcaccaggtttgctgaaactgacagagcctgggctccagacctctctccctcctacagtgctctccctccctgggcagattggcaggacaagtgggagcagatggcctgcctttggctgagagggctacctgcccagcccctcccccaacaagatctcttggactcaggcctcagagcctggcctggttgtgagtgtgtgtccctgtgtgtgtgttgcgggaggggaggactggggctggaagtccagcacccagggaagatctgtcctcctgttcttgggaagcgttgcctgacggcttctcggctctaccctcacccttctggccaggatcccgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattcccccagcctctttctgctttcatgctcagcacatcatcttcctaggcagtctcttccccaaagtctcaccttttcttccaatagaaaattccgcttgacctttggtgcactgcccacttcccagctccactggcccaagtctgagccggaggcccttgttttgggggcggggggagagttggatgtgattgcccttgaagaacaaggctgacctgagaggttcctggcgccctgaggtggctcagcacctgcccagggtaggcctggcatgaggggttaggtcagccaatgtcagctgcttctcttggggccctctcagagtctatctccccaagacaggaagggaaaagcaaatttctaattcaccagcaataaaaattggaggaggcttggccctcagcccttatatctctctctttttcactctcttcctcccacccccaagactgagttttggggggcaaggtggagagagctggcaactactgtgagcaagtcccctagcccctgaccagcctcctcccatgactggtgactgtttaatgagctgtgcatcccccacaaaaacatgagtgcccctctgtgtggcctctaaccctctgcacagcccttctgggtggtcctcaccaggtctctgagctgggtgggaggccatcctggcgaccactgcccattccattcacccctcactgtacctgccctagaacctgggcctaggccacaggggcagggagaagagaaggcattagtaagaaaaaaatagaaaaaaatatgaacagactcagctttgggacgtccaaccacaaaagaaattatatataaatatatataaatatatatctctaccatatgtgatggaaagactttttgttttcctttcccaaagaaataaaacggaaaaagcctcttgagtggta

SEQ ID NO: 5164 - DNA, 5099 bp, Homo sapiens
cgcttgtgggccggccttgggggagggggacgcgcacccacagaaggactcagagggcttcacggtaagctgagcagggtcaaggtccacagggagcgggagagggtagtaatccgggaagtcttcctggtggcagtgaattctttgcggggttcggcaggcgcaggatccttggggccgcgcaccctgcagcggcccctcccctcccctcccccctcccacctgtgggaaacgcaggccctgagagaggctccgtcagtgccagcagctggcgccactgcgtcccctgccccggcctcagccagccctgggacctctgcggaggactgatcccgggaagggggccctgtcttcccagggccccggtgcggccgagctgggaagaccttggggagggcaggcctgccacctactgcagccgcggcccccgtccatccgggagggacaggctgtgcccttggcggcgcccacccgcgacccagatgtgcgtcgcctacccaccctcccccagacccccgtttcctcaggcgctcgccgcctcggggcgcctggcacgcggcagccccgcaaggtaggtccttcattcctcccatttcgcagaggagaaaactgcagtccgggatggctcagtcggcccctccaaagtcgcgcagctggttcgggccgagccccgactgcgagagtgaggcacatggcccctgcagaccgggcctcggagggtcccaggcttgaggacccgtcggcccctcaaccccttggaaaggcaaggagagaagcctgcgctggtagtgagcttccacttctgccctgactgcaacacttaggttagggggctgggaaggacccccaccctcaatttttggataggggtgtatttctctccctcccctaatttctgaggttggttccctgttggattcaggtactgctctccccttccaaccccatttccccagcccatgaggttgggatattagggtcccagacccaagataaagaaccccaaaattctggggttgcagcaaagagttgagagggtcactgagcctgggaagctcatggcggaggtggggctaaggcagaagtttaggaatggaacgctgagctgagctgagctgagctgagctgagcaacgctgggggctatgtgcatggagccctgggggttgggctttatcaggtgggcaacaggcagcccccattcccaagttctctcttttatcccagccttattccttcaccttggatgcctgggaactttttgtacccattgtagggaaggggacactgaggggcagagcggtgccgggttgacttggctggggtggtgggaataggagtagggtcttacctatctctgccttcccacctgtgcccacagtgcccccctggcttagtcatggcgaagctggagacgctgcctgtgcgcgctgacccagggcgggatcctctcctggcctttgccccacggccctccgagcttggacccccggacccccgcctggccatgggcagcgtgggcagtggggtggcccatgcccaggagtttgccatgaagagcgtgggtacccgcacagggggtgggggcagccagggcagtttccctggcccccgaggcagtggcagtggggccagcagggagaggccgggccgctacccctcagaggacaagggtctcgccaactccctctacctcaatggtgagctgcggggcagtgaccacaccgatgtctgtggcaacgtggttggcagcagcggaggcagcagcagcagtggtggcagtgacaaagccccaccgcagtatcgtgagcccagccacccacccaagctcctggccacctctggcaagctagaccagtgctcagaaccactagttcggccgtcggccttcaagcctgtcgtacccaagaatttccactccatgcagaatttgtgccccccgcagaccaatgggactcctgagggacggcagggccctggtggcctcaaaggcggactggacaagtctcggaccatgactccagcgggtgggagtgggagtggcctctcagactcaggccggaactccctcacaagcctgcccacctacagctccagctacagccagcacctggcacccctcagtgcctccaccagccacattaaccgcattggcactgccagctatggtagtggtagtggcggcagcagcggtggggggtcgggctaccaggacctggggacctccgatagtggacgggcctccagcaagagtgggtcgtcgtcatctatggggcggccaggccacctgggctctggggagggcggaggtggaggcctgcctttcgcggcctgctcaccgccctcccccagtgcactcatccaggagctggaggagcggctgtgggagaaggagcaggaggtggcagctctgcggcgcagcctggagcagagcgaggcggctgtggcccagcaggacaagaagcagctgcaggaggaggcggcccggctgatgcggcagcgggaagagctggaggacaaggtggccgcctgccagaaggagcaggccgacttcctgccccggatagaggaaactaagtgggaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtgtggctggaggagaaggagaaggtgatcgagtaccagaagcagctgcagctgagctacgtggagatgtaccagcgcaaccagcagctggagcgcaggctgcgggagcgcggggccgcagggggtgcaagcacgcccactccccagcatggcgaggagaagaaggcctggaccccctcccgcctcgagcgcattgagtccacagaaatctgatcgacctgggcactcggcattttgacacatgtcctgtcaaaaggccagagtccccagtgtcccctcccctccatctctcttccccatagaccccataaccccagaccaaagaggttctctaagcagctgtgaccaggttcctccctccccacctgccctcctagctccagcactgcccccgtggcagcccacttggacccccctaaaaggagggaataggaggagggcagggtgagtgggggcaatcctaggtggtgggggagtcatgctccctttctcggcacccccttgttggagatggaggcagcagacgtgcagtgccataaggtgccccagtccttctggaggcctgggctgctactgttggccaccctgtgtctagtgatgctctctgtgctcacctcctaggccatggagcctgagggggcctgcaccaggtttgctgaaactgacagagcctgggctccagacctctctccctcctacagtgctctccctccctgggcagattggcaggacaagtgggagcagatggcctgcctttggctgagagggctacctgcccagcccctcccccaacaagatctcttggactcaggcctcagagcctggcctggttgtgagtgtgtgtccctgtgtgtgtgttgcgggaggggaggactggggctggaagtccagcacccagggaagatctgtcctcctgttcttgggaagcgttgcctgacggcttctcggctctaccctcacccttctggccaggatcccgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattcccccagcctctttctgctttcatgctcagcacatcatcttcctaggcagtctcttccccaaagtctcaccttttcttccaatagaaaattccgcttgacctttggtgcactgcccacttcccagctccactggcccaagtctgagccggaggcccttgttttgggggcggggggagagttggatgtgattgcccttgaagaacaaggctgacctgagaggttcctggcgccctgaggtggctcagcacctgcccagggtaggcctggcatgaggggttaggtcagccaatgtcagctgcttctcttggggccctctcagagtctatctccccaagacaggaagggaaaagcaaatttctaattcaccagcaataaaaattggaggaggcttggccctcagcccttatatctctctctttttcactctcttcctcccacccccaagactgagttttggggggcaaggtggagagagctggcaactactgtgagcaagtcccctagcccctgaccagcctcctcccatgactggtgactgtttaatgagctgtgcatcccccacaaaaacatgagtgcccctctgtgtggcctctaaccctctgcacagcccttctgggtggtcctcaccaggtctctgagctgggtgggaggccatcctggcgaccactgcccattccattcacccctcactgtacctgccctagaacctgggcctaggccacaggggcagggagaagagaaggcattagtaagaaaaaaatagaaaaaaatatgaacagactcagctttgggacgtccaaccacaaaagaaattatatataaatatatataaatatatatctctaccatatgtgatggaaagactttttgttttcctttcccaaagaaataaaacgg

SEQ ID NO: 5165 - DNA, 4055 bp, Homo sapiens
gcgcgccccgccgggcgtgcttcgggctgcgccagcaagcggggccggtggcgcccgtgtcggagaccccgcgccggaccctgaggcagcgaaggagaaaactgcagtccgggatggctcagtcggcccctccaaagtcgcgcagctggttcgggccgagccccgactgcgagagtgaggcacatggcccctgcagaccgggcctcggagggtcccaggcttgaggacccgtcggcccctcaaccccttggaaaggcaaggagagaagcctgcgctggtagtgagcttccacttctgccctgactgcaacacttagtgcccccctggcttagtcatggcgaagctggagacgctgcctgtgcgcgctgacccagggcgggatcctctcctggcctttgccccacggccctccgagcttggacccccggacccccgcctggccatgggcagcgtgggcagtggggtggcccatgcccaggagtttgccatgaagagcgtgggtacccgcacagggggtgggggcagccagggcagtttccctggcccccgaggcagtggcagtggggccagcagggagaggccgggccgctacccctcagaggacaagggtctcgccaactccctctacctcaatggtgagctgcggggcagtgaccacaccgatgtctgtggcaacgtggttggcagcagcggaggcagcagcagcagtggtggcagtgacaaagccccaccgcagtatcgtgagcccagccacccacccaagctcctggccacctctggcaagctagaccagtgctcagaaccactagttcggccgtcggccttcaagcctgtcgtacccaagaatttccactccatgcagaatttgtgccccccgcagaccaatgggactcctgagggacggcagggccctggtggcctcaaaggcggactggacaagtctcggaccatgactccagcgggtgggagtgggagtggcctctcagactcaggccggaactccctcacaagcctgcccacctacagctccagctacagccagcacctggcacccctcagtgcctccaccagccacattaaccgcattggcactgccagctatggtagtggtagtggcggcagcagcggtggggggtcgggctaccaggacctggggacctccgatagtggacgggcctccagcaagagtgggtcgtcgtcatctatggggcggccaggccacctgggctctggggagggcggaggtggaggcctgcctttcgcggcctgctcaccgccctcccccagtgcactcatccaggagctggaggagcggctgtgggagaaggagcaggaggtggcagctctgcggcgcagcctggagcagagcgaggcggctgtggcccagcaggacaagaagcagctgcaggaggaggcggcccggctgatgcggcagcgggaagagctggaggacaaggtggccgcctgccagaaggagcaggccgacttcctgccccggatagaggaaactaagtgggaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtgtggctggaggagaaggagaaggtgatcgagtaccagaagcagctgcagctgagctacgtggagatgtaccagcgcaaccagcagctggagcgcaggctgcgggagcgcggggccgcagggggtgcaagcacgcccactccccagcatggcgaggagaagaaggcctggaccccctcccgcctcgagcgcattgagtccacagaaatctgatcgacctgggcactcggcattttgacacatgtcctgtcaaaaggccagagtccccagtgtcccctcccctccatctctcttccccatagaccccataaccccagaccaaagaggttctctaagcagctgtgaccaggttcctccctccccacctgccctcctagctccagcactgcccccgtggcagcccacttggacccccctaaaaggagggaataggaggagggcagggtgagtgggggcaatcctaggtggtgggggagtcatgctccctttctcggcacccccttgttggagatggaggcagcagacgtgcagtgccataaggtgccccagtccttctggaggcctgggctgctactgttggccaccctgtgtctagtgatgctctctgtgctcacctcctaggccatggagcctgagggggcctgcaccaggtttgctgaaactgacagagcctgggctccagacctctctccctcctacagtgctctccctccctgggcagattggcaggacaagtgggagcagatggcctgcctttggctgagagggctacctgcccagcccctcccccaacaagatctcttggactcaggcctcagagcctggcctggttgtgagtgtgtgtccctgtgtgtgtgttgcgggaggggaggactggggctggaagtccagcacccagggaagatctgtcctcctgttcttgggaagcgttgcctgacggcttctcggctctaccctcacccttctggccaggatcccgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattcccccagcctctttctgctttcatgctcagcacatcatcttcctaggcagtctcttccccaaagtctcaccttttcttccaatagaaaattccgcttgacctttggtgcactgcccacttcccagctccactggcccaagtctgagccggaggcccttgttttgggggcggggggagagttggatgtgattgcccttgaagaacaaggctgacctgagaggttcctggcgccctgaggtggctcagcacctgcccagggtaggcctggcatgaggggttaggtcagccaatgtcagctgcttctcttggggccctctcagagtctatctccccaagacaggaagggaaaagcaaatttctaattcaccagcaataaaaattggaggaggcttggccctcagcccttatatctctctctttttcactctcttcctcccacccccaagactgagttttggggggcaaggtggagagagctggcaactactgtgagcaagtcccctagcccctgaccagcctcctcccatgactggtgactgtttaatgagctgtgcatcccccacaaaaacatgagtgcccctctgtgtggcctctaaccctctgcacagcccttctgggtggtcctcaccaggtctctgagctgggtgggaggccatcctggcgaccactgcccattccattcacccctcactgtacctgccctagaacctgggcctaggccacaggggcagggagaagagaaggcattagtaagaaaaaaatagaaaaaaatatgaacagactcagctttgggacgtccaaccacaaaagaaattatatataaatatatataaatatatatctctaccatatgtgatggaaagactttttgttttcctttcccaaagaaataaaacggaaaaagcctcttgagtggta

SEQ ID NO: 5166 - DNA, 2895 bp, Homo sapiens
cagcctccctctcccacctctgtctgcccgctgcctcttgtctagctgctgtcaggagctgactgcctccagggctggaatcctgtgctccctctgtgcccagagccccacgatgtcggccaacgccacactgaagccactctgccccatcctggagcagatgagccgtctccagagccacagcaacaccagcatccgctacatcgaccacgcggccgtgctgctgcacgggctggcctcgctgctgggcctggtggagaatggagtcatcctcttcgtggtgggctgccgcatgcgccagaccgtggtcaccacctgggtgctgcacctggcgctgtccgacctgttggcctctgcttccctgcccttcttcacctacttcttggccgtgggccactcgtgggagctgggcaccaccttctgcaaactgcactcctccatcttctttctcaacatgttcgccagcggcttcctgctcagcgccatcagcctggaccgctgcctgcaggtggtgcggccggtgtgggcgcagaaccaccgcaccgtggccgcggcgcacaaagtctgcctggtgctttgggcactagcggtgctcaacacggtgccctatttcgtgttccgggacaccatctcgcggctggacgggcgcattatgtgctactacaatgtgctgctcctgaacccggggcctgaccgcgatgccacgtgcaactcgcggcaggtggccctggccgtcagcaagttcctgctggccttcctggtgccgctggcgatcatcgcctcgagccacgcggccgtgagcctgcggttgcagcaccgcggccgccggcggccaggccgcttcgtgcgcctggtggcggccgtcgtggccgccttcgcgctctgctgggggccctaccacgtgttcagcctgctggaggcgcgggcgcacgcaaacccggggctgcggccgctcgtgtggcgcgggctgcccttcgtcaccagcctggccttcttcaacagcgtggccaacccggtgctctacgtgctcacctgccccgacatgctgcgcaagctgcggcgctcgctgcgcacggtgctggagagcgtgctggtggacgacagcgagctgggtggcgcgggaagcagccgccgccgccgcacctcctccaccgcccgctcggcctcccctttagctctctgcagccgcccggaggaaccgcggggccccgcgcgtctcctcggctggctgctgggcagctgcgcagcgtccccgcagacgggccccctgaaccgggcgctgagcagcacctcgagttagaacccggcccacgtagggcggcactcacacgcgaaagtatcaccagggtgccgcggttcaattcgatatccggactcctgccgcagtgatcaaagtccgaggggcgggacccaggcacctgcattttaaagcgccccgggagactctgaatctttttcagaaacagtgagttaaagcagtgcttctcaaaccttgatgtgcctgtgaatcacctaggggtcttgttaagtgcagtctgatccaggaggccggggccgggtactgagagtctgcacttaacaagctcccaggccgagaagccagtgcggcaggttcacaggcgaggcctggagtaacacaaagtgaaactcataatagacttcccactctagggcagtggagtcggaagggcacacggggtgcgtctccccggagttcagttttaccagatgatgggggaggggggaaggagttttatgttaaaccatccatgtatttttggagaagagagaggaaaggtttgagaagcactgttccagcctgccctcttcatttagccaatgcttactgcgctagacgcttcatcccacaatcttaaggggcagcttctattagccagtctttacagctgagcacattctggctcagggaggttaagtgacttgcccagtttcagggctaacgaccacagggtctgcactctaaccctaggcatcacatgctcaatgactctctggtgagcgaggacattctctgacctactcgagggacttaagatgctaccttgtgacccagcactgcccaaagtgcttccaaggcagaagcagcaggggatggcgtggtcaagcactcgggaaacctggggctaatcaaatccaatgggggaaatgactaaaagtcttcggtcgttagaagttgaatgggcacagcaactctaagactacagcacacgtcatttcttagctaagcggaccagcctccctgtcggcctggtgttctgtgggatccctctgggcactggtaatcccaagatctgtgcagccccgcctccaggccacatggggctgggcagctaccatttcccttttgcggatgggaggggtaacttgcacctctgacctatcacttccactgcaccccgtctcattcctccacctgccgtggacttggggtcagagactgctgtgtttgagctctgcagcccagggaccgaaaagttggtgtcaatgaattttgcttggtggatgaaatgtcagtggaagaagcagatgagaaactcttgagatcttggtcctgtgttttttctgccaccaaaggccagggtcactgaaggcctggcccacagcaggtgctgagcaaagggaacagtgaggtgcccagctagctgcagagccaccctgtgttgacacctcgcccctgctccctcccatcccttccccctttactcatagcacttcccccattggacacgtggtgcattttgcttgtttattatgttttctctccatcagaatgaaagctcctcgagggcagggactttggtctattgtctgtatttgccggtgcctaggattgtgcctgtatgcaacaggcactcaataaatatttttgctgta

SEQ ID NO: 5167 - DNA, 5011 bp, Homo sapiens
agaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaagccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctgatattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctcaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 5168 - DNA, 1539 bp, Homo sapiens
atgaggtctcccgccgtcccgacccccgcaaggggccagcttggtgtcgccttcgttcttctgccaccccattcggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgagtggtgaccctgtcatgtacaggagggaccctggggcatgtggggggggtggggttgggaaagaagcagggcgaccttggccttggggagagcagagcagagggagaggcagcagtcccagcggtcctaggctgtcgggaaactgcagcccagcctcagggccatgggaggtggtatccaggcctgggtggggccaggcctctgctcacagggatgtggggtcagtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagcctttt

SEQ ID NO: 5169 - DNA, 1875 bp, Homo sapiens
agtggttcggccgcggcgaccccactccggcggcgcgtcccccgagcttggtacggctcagcccgtctcccccgaagccgcgcgcccgcgcccgcgcccctcagtcggtggagcccgcagccccccttgtggcccgcggcagctccccgcccgctcggcccgcgcccgccatggtccgtccgcgccgtgccccgtaccgctccggcgccgggggccccctcgggggtcgcggccgccctccgcggcccctcgtggtgcgcgccgtccgctcgcgctcctggcctgccagcccccgaggcccgcagcctccgcggatccgggcccgctcggcccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgagtggtgaccctgtcatgtacaggagggaccctggggcatgtggggggggtggggttgggaaagaagcagggcgaccttggccttggggagagcagagcagagggagaggcagcagtcccagcggtcctaggctgtcgggaaactgcagcccagcctcagggccatgggaggtggtatccaggcctgggtggggccaggcctctgctcacagggatgtggggtcagtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagcctttt

SEQ ID NO: 5170 - DNA, 1005 bp, Homo sapiens
ggcctctgtcacccccgggcccacagcacagcccagggccatgctcctgttctcagtgttgctgctcctgtccctggtcacgggaactcagctcggtccacggactcctctcccagaggctggagtggctatcctaggcagggctaggggagcccaccgccctcagccccctcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctgctgacaaaaactctgtgaaaacggatctgatgaaagcgccaatggtcatcatggactgggaggagtgttcaaagatgtttccaaaacttaccaaaaatatgctgtgtgccggatacaagaatgagagctatgatgcctgcaagcaaagctattttcccactttacaaagaatgaacaccggaagctctcaaacaaagccgcctgggtctcacacctttcatctgcaaaactgatgctttgctctttcttctacatggagccatttttggggcagaaaacatacccttgggcatagccttgagttgaaaatctttgagggtgttttctgtccaaatgactgaaaaaatgaataaaagcctccccattt

SEQ ID NO: 5171 - DNA, 1124 bp, Homo sapiens
ggcctctgtcacccccgggcccacagcacagcccagggccatgctcctgttctcagtgttgctgctcctgtccctggtcacgggaactcagctcggtccacggactcctctcccagaggctggagtggctatcctaggcagggctaggggagcccaccgccctcagccccctcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctgctgacaaaaactctgtgaaaacggatctgatgaaagcgccaatggtcatcatggactgggaggagtgttcaaagatgtttccaaaacttaccaaaaatatgctgtgtgccggatacaagaatgagagctatgatgcctgcaagggtgacagtggggggcctctggtctgcaccccagagcctggtgagaagtggtaccaggtgggcatcataagctggggaaagagctgtggagagaagaacaccccagggatatacacctcgttggtgaactacaacctctggatcgagaaagtgacccagctagagggcaggcccttcaatgcagagaaaaggaggacttctgtcaaacagaaacctatgggctccccagtctcgggagtcccagagccaggcagccccagatcctggctcctgctctgtcccctgtcccatgtgttgttcagagctattttgtactgataataaaatagaggctattctttca

SEQ ID NO: 5172 - DNA, 2366 bp, Homo sapiens
agttggcggctgcctccggccggccggactttgcgagcagcctggagaggatccgcgaccgccgccgccgccgccgcggaggcttcggggctgcttccctcgagcttagcccgcagcgcgggtggagaggggcggggagggggtcgggggcacgagaagaacttgaaaccgtgtgaaggaatccggagcagatgagaagggaggaaaataaaagaaagtggagactgcagaacagactccgctgtggctgactgtgccggccgacgctccagctgaggggctgggttggatttttttttttctcccatcctctcgctctctcttttaaagcgacaccagctctctctcctcctctactatctcggtatcaccaaacccttgccggctcttatgggcatgaaacactcctcccgctgcctgctcctgaggaggaaaatggcggagaacgcggccgagagcaccgaggtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttgggatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggtgggagaatgtctatggctttgacatgacctgcatccgggacgtggccatgaaggagcctctagtggacatcgtggatccaaagcaagtggtgaccaatgcctgtttgataaaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttagcacacgtgggaagctgcagagagcaacgagaaaaggaactctcacctcgatctgccgtgccgtcccaaagaataccgtttgcaggactacacacttgaaaaccagagttttcaactctgccttgaagattggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaacaaa

SEQ ID NO: 5173 - DNA, 1204 bp, Homo sapiens
atttctgcaccagggaggcttgctgtttgaatgtgtgccaggttgaatggagtctctggcttcagatggattcaagctgaaagaggtttcttctgtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttgggatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggtgggagaatgtctatggctttgacatgacctgcatccgggacgtggccatgaaggagcctctagtggacatcgtggatccaaagcaagtggtgaccaatgcctgtttgataaaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttag

SEQ ID NO: 5174 - DNA, 4127 bp, Homo sapiens
gaggaaggggcggggtcggggcgggcctccgcgctcctcccgccctctctgtgtccctactctccctccccttccctcccccacactcggccccgtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactggtaatgtagacttcatgtcacttgtacaaggagaattgtattttactccgtgtatttacacattttgctattagttgatattcaaggaattattttcattccaaacttaggaatggataaaagccaactttttgtacatgagttggaatgcccactgtttgaccaaagatgtaaataaagtagaacctatgtctctaagtcttgtgaccttgaagtctaattcaaaaatctaatcatacttggattataaagaagttgagaactgcctgaatataaaagctaccatgcttatgttattgtgggaaggagttctggaatcagatagacatggacctcaaagtaagctgacagaactcattccaggggaacagtaaggccaccttctaaactaggagaggacaaactgaaagtgtatatt

SEQ ID NO: 5175 - DNA, 6398 bp, Homo sapiens
gcgcaggggatcggcgggaagctctttcacccccgcttctgccgggctgtaactgcaatggagcaggttgagatgaactcagtcagatggccccacggcccgctcctttcttagcagcccactaatgctccagaaccctcaggagaagagccaggcctacccccgccgccgccggcctggctgctacgcatagcgtcagaaccccgaggccatcgcagccgcagctatgtacaccttcctgcccgacaacttctcacctgccaagcccaagccttccaaagacctgaagccgctgctgggctccgcggttctggggctgctgcttgtgctggccgcggtggtggcctggtgctactacagcgtctccctacgcaaggcggagcgacttcgcgcggagctgctggacctgaaagctggcggcttctccatccgcaatcagaagggagagcaggtcttccgcctggccttccgctccggcgcgctggaccttgactcctgcagccgcgatggcgccctgctgggctgctcgctcacggccgacgggctgccgctgcacttcttcatccagactgtgcggcccaaggacacggtcatgtgctaccgcgtgcgctgggaggaggcagcgccgggccgggccgtggagcacgccatgttcttgggcgacgcggcggcccactggtatggtggcgccgagatgaggacgcaacactggcccatccgcctggatggccagcaggagccccagccgttcgtcaccagcgatgtctactcctccgacgccgcgtttgggggcatcctcgagcgctactggctatcttcgcgcgcggccgccatcaaagtcaatgactcagtgcccttccacctgggctggaacagcacggagcgctcgctgcggcttcaggcgcgctaccacgacacgccctacaagccacccgccggccgcgccgcagcgccagagctgagctaccgagtgtgcgtgggctcagacgtcacctccatccacaagtacatggtgcgtcgctacttcaacaagccgtcaagggtgccagcacccgaggccttccgagaccccatttggtccacatgggcgctgtacgggcgcgccgtggaccaggacaaggtgctgcgttttgcccaacagatccgcctgcaccacttcaacagcagccacctggaaatcgacgacatgtacacacctgcttatggcgacttcgacttcgatgaggtcaaattccccaacgccagcgacatgttccgccgcctgcgcgacgccggcttccgcgtcacgctctgggtgcacccttttgtcaactacaactcgtcgcgcttcggcgagggcgtggagcgcgagctgttcgtgcgcgaacccacgggccggttacctgcgctggtgcgctggtggaacggcatcggcgcggtgctagacttcacgcacccaaaggcccgcgactggttccagggacacctgcggcggctgcgctctcgctactccgtggcttccttcaagttcgacgcgggcgaggtcagctacctgccgcgggacttcagcacctaccggccgctgccggaccccagcgtctggagccggcgctacactgagatggcgctgcccttcttctcgctggcggaggtgcgcgtaggctaccagtcacagaacatctcctgcttcttccgcctggtggatcgcgactctgtgtggggctacgacctggggttgcgctcactcatccccgcggtgctcaccgtcagcatgctgggctacccattcatcctacccgatatggtgggcggcaacgccgtgccccagcggacagccggcggcgatgtgcccgagcgcgagctctacattcgctggctggaagtggccgcctttatgccggccatgcagttctctatcccgccctggcgctacgacgcggaagtggtggccatcgcgcagaagttcgccgccctgcgggcctcgcttgtggcaccgctgttgcttgagctggcgggcgaggtcaccgacacgggtgaccctatcgtgcgccccctttggtggattgcgcccggcgacgagacagctcaccgtatcgactcgcagttccttattggggacacgctgcttgtggccccggtgctggagccaggcaagcaggagcgcgacgtctatttgcccgccggcaagtggcgcagctacaagggtgagcttttcgacaagacgccggtgctgctcaccgattacccggtcgacctggatgagatcgcctactttacctgggcgtcctgacccagcccagggcccggtaaccgcaaagcccccagtcttcatgcagaccttgaaccctccgtcacacccgcaccatgtactcccaggaacctcccacctctataccacccattaagtggctgctgacttaaatgtgctggaaccagctgctgaaggtggggcctagggagggggcactgaagcaatctcctgctccaacgcacaatccttactgtgccctttccacccccacactcacaccaatctgcagaaacctcttccctggggtggaagccagagagcttagaggaaaaaggtcagctctcttcctgttatacatggttatacatggttggggtttaaaagcacaaagagaaacctccccctcctggctttcgtggccatctttgtccatcttaggtggggacttgatcttatttaaggtctccaaatagcccccaccacacttagaacgtgtgttttcttagtgttagaagccaggccctgagtccccagcactcacctgaactgtggctgatttggtcccagtccagctggggaggtgtttggctgacaaggaggcaagagatcccctcccagggaacaggaggactgggcttagcacagagccatcatcatgttcccaatttgtgaagagactcctaacactgcactaacccatttgtgtacatacatgggctcagccctgggccaaatgtgcctgatgggaacagacttgcagggccatgcaggccagacttcgtgccttaactgaagagtgtgcgtgtgtgtgtgtgagagagagagagagagagaaacacgcatcatgggtccctgatctatgaaatgaacacaacctctctgaggctggatgatctggaggaagggggcatggagcaaatttgaggctctgattgctgagccagcctcctcccaggcggtttccccaggactctcgtaggaaataaatagccctttcaagattcctcagctgcctcaccccctgcacatgtgcctggggtgtggcctagaagggagtgatgttcttactctggtggtctgtgcttctgaacacaggctacatgcacacactgacaactaccaataaacagacaggggaaggtctttcatctcagccattttctcttccccccgcccccccttagatggagtcttgctctgtcacccaggttggagtgcagtggcacaatcagctcactgcaacccctcctcctaggttcaagcgattgagtagctgagattacaggcatgcatcactatgcctggctttttgtattttttagtagagatggggtttaccatgttggccaggctagtctcaaactcctgacctagtgatgcacccaccttggcctcccaaagtgttgggattacaggcatgagccaccacgccagccattttctctttctaagaagagcaacctcagccggagtgagttttttctgactttgcagctgagtctggagaaaagtggcatgccagagcgggtcggtgggaaacagggtgaactttagcttccatcaacagctctggtagcaaaaccagtcccctaccccctagagaatgcatccgtttccccacctgatatggtttggctgtgtccccacctaaaactcatcttgaattgtagctcccataattgccatgtgttgtgggaaggacccagtgggagataattgaaatatgggggcagtttccgccatactgttctggtgatagtgaatagatctcatgagagctgatgattttataagaggtttccccttttgcttagttctcattctctcttgcctgccgccatgtaagacgtgcctttctgtcatgcttgtgaggcctccccagccacgtggagctgtgagttcattaaacctctttttctttataaattacccagtcttggttatgtctttatcagcactgtgaaaatgaacctatacagtaaattggtaccagtagagtggggcgctgctgtaaatacccaaaaatgtggaagcaactttggaactgggtaacaggcagaggttggaacagtttggagggatcagaagacaggaaaatgtgggaaagtttgggacttcctagagacttgttaaatggctttgaccaaaatgctgataatgattgggacatgaaatccaggctgagttggtctcagatagcgatgaggaacttgtttggtactggagtaaaggtgactcttgctatattttagcaaagagactggctgcattttgcccctgccctagagatttgtggaactttgaactcgagggagatgatttagggtatctggcagaagaaatttctaagcagcaaagcattcatgaggtgacttgggtgctgttaaaagcattcagttttaaaagggaaacagactataaaagtttggaaaatttgcagcctgatgatgagatagaaaagaaaaacccattttctgaggataaattcaagccccctgcagaaatttgcataagtaacaaggagccaaatgttaatcactaagacatggggaaaatgtctgcagggcatgtcagagacctttgcagcagtgcctcccatcacaggcctggaggcctaggagggaaaaaatggttttgtgggccaggcccaaggtccccttgctgtgtgcagcccagggacttggtaccatgcatcccagctgctctagtcatggctaaaaggggccaagatacagctcaggccttggcttcagagggtgcaagccccaagtcttggcatcttccacgtagtgttgagcctgcaggtgcacagaagtcaagaactgaggtttgggaacctctgcctagatttcagagaatgtatggaaatgcatgtatgtccaggcagaagtttgctacaggagtgaggccctcatggagaacctctgttaaggcaatgtggaaggggaagcccccacacagagaccccactgggacactgcctagtagagctgtcagaagaaggccaccgtcctccagacatcagaatggtatatccactgacagcttgcaccatgcacctggaaaagccacagacactcaacgccagcctgtaaaagcaaccgagaagtaggctgtaccctgcaatgccataggggtggagctgcccaagaccatgggaacccacctcctgcatcagtgtgacctggatgtgagacatggagtcaaaggagaccattttggagctttaagatttaactgccctgctggatttcagacttgcatggggcctttagccacttcgttttggccaacttctcccacttgaaatgggtgtatttagccaatgcctgtacctccgttgtatctaggaagtaactaactagcctttgattttacaggctcataggtggaagggacttgccttgtttcagatgagactttggagtatggacttttgagttaatgctgaaatgagttaagactttgggggactgttgggaaggcatgattgatttttaaatgagaggacatgagatttgggaggggccagggagagaatgatatggtttggctgtgtccccatccaaatatcaccttaaattgtagctcccataattgtgggagggacctggtgggagataattgaatcataggggcagtttctcccatactgttctggtggtagtgaataagtctcacgagatctgatggtttaataaggggtttccccttttgcttggctctcattctctcttgtctgctgccatgtaagatgtgccttttgccttccaccatgattgtgaggcctcccagccacatggaactgtgagttcattaaacctctttttcttcataaattacccagtctcgggtatgtctttatcagcagtgtgaaaacagactaatacaccactcctctaccttctttattttctcagtgtggaaaatgcctgatgaaagctttggggccctcacagatgcacaactcaagtgctgattctatcacttatctaccagctctgtgaccttgaacaagccgcttaaccttgctaagcctctgttttctcatatgtcaaatggtgataataatgcctacctcccgaggttgttgtaagaattataagcacaaatgtatgtaaagtgcctggcacaaagtaggtgctcaataaatggtagctattataat

SEQ ID NO: 5176 - DNA, 355 bp, Homo sapiens
ggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatctgtgagtgaactgagaactgtgtctactggctgcctcagggatgaaagacttaccattgccaactctgcctggctgattcctgaataaggaacatgttggccaaaagatgcctctcct

SEQ ID NO: 5177 - DNA, 1665 bp, Homo sapiens
gcccccacaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggtggcatctaggaccctggctccctgcagtggggacttcgtgggaggcactcatggctctctgggtctaa

SEQ ID NO: 5178 - DNA, 657 bp, Homo sapiens
caagtgaagaaggtcctttttgaggacgacgagagaagcacggattcttcccagcagtgttcatctgaggatgaagacatctttgaggaaaccgcccaggtcagccccccgagaggcaaggagaagagacagtggcgggcacggatgcccttgctcagcgtccagcctgtcagcaacgcagattgggtgtggctggtcaagaggctgcacaagctgtgcatggaactgtgcaacaactacatccagatgcacttggacctggagaactgtatggaggagcctcccatcttcaagggcgacccgttcttcatcctgccctccttccagtccgagtcatccaccccatccaccgggggcttctctgggaaagaaaccccttccgaggatgacagaagccagccccgctcaggctccaccgggagctccctcagtgtctcggtgagagacgcagaagcacagatccaggcatggaccaacatggtgctaacagttctcaatcagattcagattctcccagaccagaccttcacggccctccagcccgcagtgttcccgtgcatcagtcagctgacctgtcacgtgaccgacatcagagttcgccaggctgtgagggagtggctgggcagggtgggccgtgtctatgacatcattgtgtag

SEQ ID NO: 5179 - DNA, 1483 bp, Homo sapiens
ccggccgccgtcgctgtccagggaggctgaggcgagaggtagctgtccgggtggggagcccgcactaccttcttcctcttcctcctcctcctccgggtgaggggagcgaaggttgggggtccccgagcccatggaccaggaggaggcggaggccgccgagagccggggccccgctatgtggccctgagccccggtaggtggccgggggcggctggctgccaggccgaggaccatgggctcaggggaggggcaagcgggacgggcgatgtcagcggctgcgctggccggatgttgggtccggaggtggcgcccctggctcggccagggcagccagctgcttctgtccttgcagtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaagctcactccaggcctgtatgaattcaaagtgattgtagagggtcaaaatgcccatggggaaggctatgtgaacgtgacagtcaagccag

SEQ ID NO: 5180 - DNA, 5408 bp, Homo sapiens
atggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagacagaatctcactctgttgcccaggctggagtgcagtggcacgatcttggctcacggcaacctccacctcacaagcagctgggactataggcatgtgccaccacgctcagctaattttttgtatttttagtagagacggggtttcattgtgttggccaggctggtctcgaactcctggcctcaagtgatctgctggccttggcctcccaaagtgctgggattacaggtgtgagccaccgagcttggccaagtgcttaaaatagttaatgctaatgccacagtccaatttaaatcttttcttagttctcaactttccttaatcttaaagcagcattcggttctgagcagctacactcagtctccactaatggctgctgagactatgtttcctctctcaattctctgatctatttgctttcttgtcattccttgttttttgtgtgtattccttgacttacctcttctcctgtcttcattaattaggttaattttggggccccatggtgtttcacgtaaaaagatttggctgggcgtgatggctcatgcctataatcccagcactttgggaggccatagtggaggatctcttgagcccaggagttccagaccagcctgggcaacatagcaagactctatctac

SEQ ID NO: 5181 - DNA, 4084 bp, Homo sapiens
atgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatctatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatct

SEQ ID NO: 5182 - DNA, 4703 bp, Homo sapiens
gaattaatcagcagattgaagctctgctctgctgcgcctgattctgtgcagcacccggcttcttgctcacacactctcagctgtctccgtctcttctctcctcttctctctctctctcttttcaccctccccgctttgagggaggtgttggaagttcttgcagctgactgcttgtggctcagactctggcccatgctctttaagcaggcagagctatggatgccccatcagggcaaaggcaacaaaggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacatcgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatgatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagaggggccctaaaccccctcacctgtgagctaccccctttagggatcccttgcccccttggagatcccttgccccccagtgcctctgctcgtgggtccctggacacggccttgaagccaaccttctttggaggagcaaca

SEQ ID NO: 5183 - DNA, 2539 bp, Homo sapiens
cgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggtaggaagccgccatctggtcgaaacccgaggccttggccttgctctcagccctgtgtctcggaaggggctagcctggcgagggggggtgaggcctgggcaggaatgggtgtcctgatgccctcagcccttgacaccagagagcgcgcacaagtgttttgagaggagacgacgaggaagggaaagctggaaatccaggtgtgaattgatggtcttctggctttccagggcagccctcccctcctcccgcatcataaatctcagcatttaaaaataactgcaagctgggtgtggtggcttgtgcctgtagtcccagctacttgggaggctgagatgggagaatcccttgagcccaggagtttgaggctgcagtgaactatgattgtgtcattgcactctagctggggcaacagagcaagaccctgtctcaaaaaagcaaaaaacaaaaaagcaaataaaagt

SEQ ID NO: 5184 - DNA, 482 bp, Homo sapiens
ttcctgcccgacaacttctcacctgccaagcccaagccttccaaagacctgaagccgctgctgggctccgcggttctggggctgctgcttgtgctggccgcggtggtggcctggtgctactacagcgtctccctacgcaaggcggagcgacttcgcgcggagctgctggacctgaaagctggcggcttctccatccgcaatcagaagggagagcaggagccccagccgttcgtcaccagcgatgtctactcctccgacgccgcgtttgggggcatcctcgagcgctactggctatcttcgcgcgcggccgccatcaaagtcaatgactcagtgcccttccacctgggctggaacagcacggagcgctcgctgcggcttcaggcgcgctaccacgacacgccctacaagccacccgccggccgcgccgcagcgccagagctgagctaccgagtgtgcgtgggctcagacgtcacctccatcca

SEQ ID NO: 5185 - DNA, 3603 bp, Homo sapiens
ctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactggtaatgtagacttcatgtcacttgtacaaggagaattgtattttactccgtgtatttacacattttgctattagttgatattcaaggaattattttcattccaaacttaggaatggataaaagccaactttttgtacatgagttggaatgcccactgtttgaccaaagatgtaaataaagtagaacctatgtctct

SEQ ID NO: 5186 - DNA, 3873 bp, Homo sapiens
catttcagcccactgaggtgtccccaagcccagactatccatgtgtggccactggggagtcccctagccttgcccagccatctcagcccactgagggagtctccaagcctggcccagcctcctcagtccactggggaatccccaagcttgacctggccatctcaggccactggggtgtccccaagtgtagcccaccaatctgtggccagtagggtttcctcaagcctagcccagccatctcaagccagtgggatgtcccctagcctagcccacccatctcagaccactgcagtatccccaaggcaagcccaaccatctgtggcctccagtccaggcaagacaaattcatcctgtaccctagcctccagcctagccgagccagctatagcccccagcctattcccaccatctgtggcccacacggaagccctaagcctggctcagtcacccccggacactaggttggccccaagccgatcccagccatctgtggtcagtggtacatgtcatggcctcaatgagccatgctggggctctaggctggattcaaatctgcagtgttcaagggtggactcagtagccccgtgtctgtgtcacccatcagcgtttgtttcagttagcctgggtggaccatatccctctgtggctggaaatatggaccagggtctgaaccagccatccctgggtactggggtgaacctatgtgaagaacctctgatggttagtgagatggtatccagccccccggacttcaagttcaacgacgtgtcccttgggttccatcatccacccagggttggtgggaggcatgtgtgtccaccctctgtggttagtgtttcaacaccaaatctctctcatgctgatgaggaggcctgttgtgtaggccagtgaatcacgcctctgttcaggggtgtggctgtaagccatccccaggagcctttggctgatgctatgttccccagtgggtctcaggggaccacatctcctggcctagctgggaatctcccctggagaaccatagcaactggcatgggccaaagtcaatgtcaggtggccaatggcatggcttcccttgcatcccaggtcttagaggcaggtggccctttgacacatccctctggaaccacagggatggcccccagcccctctctggcttcagtgcccaacagactggccgtgactcagtctaatctttccctgaacagcatggaccccagcagctcccagatcagtgtggttattccaaaaaacatagactgctggcacccttctgaggcatccatggtcccacccagttaccagcagagagatgtgattccgcaggactctctgaagagcagggctggtcgtggtgcggcaggaggttttgtagccagtagaatgagcacgggcgcagtcccaggcactctgcctggtggcataacctccagccttcccccgggctccaccatccgaggcatgggtcacagccttcccgcaggctctgtgtccagttgggtggctcccagtctgatggcagacagaaagaagccaagtctatctgtaagaccctccgctagcttagctgctccaaacttgctcccaggttcagtagtgagtcgggtgagcccagttgtccccctggttctgtgccaatgatgggggcctctagtgtggctcagagctgctccaaggggcccatggtgattgacatcactgcccctccttacctcaaagcctggctggggagaggtctttagcccccttgcagatgccccacaccaccagtctggctccaggtcactcctcagccccggcagctagtggcacagtgaggagtctacaccgagtgcccacggttctatcaagagccttacaattgagccaagatgctaggataatgccatctggggtcacaggggaccaagccaagctaggagaattggatgaggctgtgttccaagtgtcaggatcaagtggatccaatgacctattcagcaaagccagggtcactggtgcaacccagtggatgtactccagtcctctgggagctgatgggggccatgatcataggtccctgtctgagaaagggtctcttccccaagggaggtggctcccagccatgctagtggcatggtccctgtccctttccaggccccgggtttagccactaagtccccctcagtttatcaacaggggtctgtcactcacgtcatacccccaaatcactctcagggtacagtggcttctaatgtagtctcaggatcaccccagctggcccgtggcagtactgaggctttcagattgctttcagtgtctgtgggcaggatggggaatcctagtcttcttcagaggtcagggaccaccagcatggtctcacatgtgccactatatccgtcctcggctagaagggcattgtccagtcccttccagacagaagctgtccccaatccactccagaaaacagtgtctggaaacatggctccgagcagccgctgggacgccatgggccctaaaaattcctacagatccgtgcatggtaggattgttccagaactgctagaaagttctgtggccagggttaggcccttacagtatgtgcaaagacaaccatcccaggcctcagcccgaagtggtgcaaaccccacccacaggccctctgcagaggtaaggcccgtcatccgcactggggagatgacacactcctcggtcattcctccgctggccccgggagttcggagggtgtctctaggctatgagtcttccccaagtggttccctgccacccctttttaaccaggagtcaccgtggagacggcaggactcctatagcccccagaatcctgccgttagtcacaaggcatccctgaactccactatactccagggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcct

SEQ ID NO: 5187 - DNA, 4401 bp, Homo sapiens
agagctgccagggattggccagaacttggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcctgccccaggtatgcccggggcctgcgatggcaaagaccccaccccagatgcacccggtcaccaccccagccaaaaacccattgcaaacatgtctgtcagccacaatgtccaagacttcatcccagaggagcccagttggggtgaccaagccctcaccccagacccgcctgccagccatgataaccaagaccccagcccagttacgctcggtggccaccatcctcaagactctgtgtctggcctctccaacagtggcaaatgtcaaggctccaccccaagtggcggtagcagccggaactcccaacacctcaggctccatccatgagaacccacccaaggccaaggccaccgtgaatgtgaagcaggctgcaaaggtggtgaaagcctcatccccctcctatttggctgaggggaagatcaggtgcctggctcaaccacatccgggaactggggtccccagggctgcagctgagcttcctttggaagccgagaaaatcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacggtaggctccctgctggcctccttgtgtgctgaagtagctggtgtgctggcatcccaggaggatctccgcactctgttggccaaagccctctcccagggagaagtctgggcagctctgaaccaggccctgtccaaggaggtcctgggtgccactgtcaccaaagccctgccccagagcatgctgagcatggcgctggtgaaggcgctgtcctggagtgagctgcgcctgaccctgtcccgagccctgtcccggggcgagctgcgggcggaactcaccaaggtcatgcagggtaaattggccgaggtgcttagcaaggctttgacggaggaggagtgggtggctctgagccaggccctgtgtcagggtgagctgggtgctctcctgagccagtcttggtgtcgggtggccctgaggactggaaccatcctccccaaggccgcctcgaaatcaacaggaagcggggtgactaagacgccggccctggtgaaggtggcctgcaggaggagtccatcggccgcatgggggccctccctgggccccgtgagaccacagaccagcaagggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcct

SEQ ID NO: 5188 - DNA, 5017 bp, Homo sapiens
gagctagcggcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagcagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 5189 - DNA, 2502 bp, Homo sapiens
tggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacgggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggag

SEQ ID NO: 5190 - DNA, 6774 bp, Homo sapiens
gtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgagggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgtgatcttttcaagtatctgaaataaaacactgtgctgctgagttcatctcaaacattcttgaaagcagggcaccagtataagttaactgtattcctgtgggttaggccgtgaatgaatcatttcttttatacaatattcttttacaactaatagagataggaggcccccaggcaagaagtttggcaggtttacagaaaatttggtaatttatttgttatataccttaatttttaaaaacccatttttattgtggtgtttggttcacatatcaactgtttaagccataattttagccaatgaatttaaatattcagtataactatttgaggtttactagatgcatttattaataaattatttgctgaaaccaaaacaagtcattgggggtgtgggaataaaatcaacctttgcttgtaattaaagttgctgctatttctgtaatgtgtatttttctccccttggtaaagggcaataaaaccattacacaaa

SEQ ID NO: 5191 - DNA, 6434 bp, Homo sapiens
cctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgagggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgtgatcttttcaagtatctgaaataaaacactgtgctgctgagttcatctcaaacattcttgaaagcagggcaccagtataagttaactgtattcctgtgggttaggccgtgaatgaatcatttcttttatacaatattcttttacaactaatagagataggaggcccccaggcaagaagtttggcaggtttacagaaaatttggtaatttatttgttatataccttaatttttaaaaacccatttttattgtggtgtttggttcacatatcaactgtttaagccataattttagccaatgaatttaaatattcagtataactatttgaggtttactagatgcatttattaataaattatttgctgaaaccaaaacaagtcattgggggtgtgggaataaaatcaacctttgcttgtaattaaagttgctgctatttctgtaatgtgtatttttctccccttggtaaagggcaataaaaccattac

SEQ ID NO: 5192 - DNA, 3213 bp, Homo sapiens
gggtattgcccgagtctgggggctggggctcgagcgaaggaggcaaggtgcagactgcctctggagagcgggcggcgagaggctgggggcccagattccttcgctttgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatg

SEQ ID NO: 5193 - DNA, 3879 bp, Homo sapiens
agagctgccagggattggccagaacttggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggacctgctacaccctgaccaccccctgccgcccccacaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcctgccccaggtatgcccggggcctgcgatggcaaagaccccaccccagatgcacccggtcaccaccccagccaaaaacccattgcaaacatgtctgtcagccacaatgtccaagacttcatcccagaggagcccagttggggtgaccaagccctcaccccagacccgcctgccagccatgataaccaagaccccagcccagttacgctcggtggccaccatcctcaagactctgtgtctggcctctccaacagtggcaaatgtcaaggctccaccccaagtggcggtagcagccggaactcccaacacctcaggctccatccatgagaacccacccaaggccaaggccaccgtgaatgtgaagcaggctgcaaaggtggtgaaagcctcatccccctcctatttggctgaggggaagatcaggtgcctggctcaaccacatccgggaactggggtccccagggctgcagctgagcttcctttggaagccgagaaaatcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacgggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcct

SEQ ID NO: 5194 - DNA, 2171 bp, Homo sapiens
atttgcattcagaaatttaaaaaatactgggccagacataaccctcaggttactttacctctgagggtgcaacctcttctcctcaaaatgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtc

SEQ ID NO: 5195 - DNA, 4765 bp, Homo sapiens
agcgagctagcggcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagcagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatg

SEQ ID NO: 5196 - DNA, 3998 bp, Homo sapiens
tgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacgggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagct

SEQ ID NO: 5197 - DNA, 889 bp, Homo sapiens
gtttccggccgccgtcgctgtccagggaggctgaggcgagagtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacc

SEQ ID NO: 5198 - DNA, 766 bp, Homo sapiens
atttgcattcagaaatttaaaaaatactgggccagacataaccctcaggttactttacctctgagggtgcaacctcttctcctcaaaagtaagaaagtgtgtttggtcaaagtcacaaagctgttagtagcagaactgcaactaaaactcagagatcttcttgtctgcgggctggtactctttccattctaccacatagtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagca

SEQ ID NO: 5199 - DNA, 553 bp, Homo sapiens
agagaggaggcggttgtcaaggcgacgtggcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttc

SEQ ID NO: 5200 - DNA, 2903 bp, Homo sapiens
cgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctgacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtgagaggcactgcctgcctcacctgcctcctcaccttgcatagcacctttgcaagcctgcggcgatttgggtgccagcatcctgcaacacccactg

SEQ ID NO: 5201 - DNA, 750 bp, Homo sapiens
cgcaggtgagctgcagaggcgcgcgtggtccctgccccacccgcgcggagccagagaggaggcggttgtcaaggcgacgtggaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttc

SEQ ID NO: 5202 - DNA, 564 bp, Homo sapiens
ttctttctctcggttcacacgccacgtgtgcaacatcggagatgctcataaaataacccctggcccgaaagggcagtagaaaacggaaatttgttggctggcttggaggatgcttccactgtgttcttcacacgagccccgggcctgcctgttgggccggttgcgcaccccgggcgcgcgctctcccgcgcccacgccgcgcgcaccagcggcggcggctgccatggcgacccgcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgct

SEQ ID NO: 5203 - DNA, 570 bp, Homo sapiens
gcgcgcgtggtccctgccccacccgcgcggagccagagaggaggcggttgtcaaggcgacaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccggga

SEQ ID NO: 5204 - DNA, 1923 bp, Homo sapiens
atggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccaggtgaaagggccaggcagttgcagctga

SEQ ID NO: 5205 - DNA, 581 bp, Homo sapiens
aatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcggctgcagctgtgatcctcggctgtctgttggcattgacgggacctgatgttttacgttattggtggaatcacagtgtctgtggttgcattcttcttcacaattaagttcctctttgagcttgccgcacgtgtagtcagcttcctccagaatgaggaccgcgagcgccgaggggaccggactatttatgactacgtgcggggaaattacctggatccccggtcttgcaaagtctcctgggattggaaggacccctatgaggtgggccacagcatggccttccgagtgcatttattctataagaacgggcagcctttccctgcacatcggcctgtgggactaagagttcacatctctcatgtcgagctagcagtggaaattccagtgacccaggaagtccttcaggagcccaattccaacgtagtaaaagtggcct

SEQ ID NO: 5206 - DNA, 2203 bp, Homo sapiens
ggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctag

SEQ ID NO: 5207 - DNA, 4970 bp, Homo sapiens
cccttctaattggccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcatcactcttgcccttgagtattatgggaagagccagggagacgggcagggggagctgaaagctgaggctccgtcctcatctctaaactctccactaaccaatttaaaggatcttaaaagcttctccaggagagagacttaggaaaaaaaaagatttctgagtcagtgctaatgagtccagttactgaatttgtgaatagctattccctggcttctggatgttagcccaagttgaatagcatagatgtggttgagagtggggtctgggagggatagagagcccaccgcccaccccccacaatcccatgactgagtggagaccaaccagcctggccaattcaaaggcaagaagatttgaggggggaaagttgtccacgtttccctctctgcttcccaccccatctctctcaacttcttagtggtcctgccatactttcctagcacctctctttcacccggggagcccaagcgtcctctagctccatctcctcgcctgctccctgcctccttttcagggctgccctgcacactggctcaccactgttggaccctgcacatggccaccttccacagatggcactccttgggagcagggtccttgtctttgtattccagtgtccccagcactgagtgcaaggccccatgcagggtaggaaacctgaggtttcaagctcagggttttaagctgtgcagtgcactaagctctctgccaaaaaacaaacaaaaaaaggtttctgtggttaaataagtttgggaaatgctgcaccagacgtcccctttttatagattcacaatacacatcagcatatttgaggttccaagaagtcctccagtaaagaacttggttaacccaatgttttctctcactgaattgagcccagagcccgtttccctacagattgcttttgagccttcctggggcaccctctgcgtgaaatgtcaccgtgtgccctccctgtggagccccactccccagcctcctcccctctgtggtcattttggattttctgactacttccttctagccatagctggggccgagggctggttcacagtctggccactgggcgtcctgtggtgaaggccagatgcagccctccctgagtggctctccctcccactcagtcactactgagctaagtactgattcaatttggggtgccaaaggttgggggtaggatatttttaagctctccaatttaaaaaggaagggcctctcctgtggaaagggaaggatggcagagtcgtgagaaaggtgttgtcaagggaccaaaaatccttggctgttcagtcactgcggtcttgatccagccccagggggatgggcttcactggcagagctgggtactgctgtgcttttgccattaaaattctgttattaatgactcatcatcagtgccccagaggaagtgtgagaggacgagagggaggtggctcccatcagcagggccagcttgggtcaggatgctgggttaaagcccggcgccctcaccaatgagacctttgtgggaagctctactgcctcagtttccctatccggagatgctgttttcagggagtcctgacactatgatgggaacaaggctatttggtttactatatcattagtgctaatatagtgtggggcactcagatgttcagtaaatatacattcaacaaataagtgagtgattatactcaactccccccacccaatgcccagcaccaagcctacccagcacatagtaggtactttaagtaatttgaatgaataattttaaataacttgaatgaataattctgtattgccccccactcgccgcctatacacacgcacacacgcacacacacacacacggtttcctgtgctacttctggcacttagtaattattcaataaacacaaaatgtttgttgca

SEQ ID NO: 5208 - DNA, 1344 bp, Homo sapiens
aggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaagaaattccagcgggagttcaggttcccaagcaatttcacgtacatggctggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggatt

SEQ ID NO: 5209 - DNA, 1799 bp, Homo sapiens
gccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 5210 - DNA, 2153 bp, Homo sapiens
agaactttgctgctgaggctgctgtggcctctgtgtgcccaggaagggacttcatttctgcctgtggattctttagaatgcccagtcgtctgcgggtcctgccctgatcacaaggagaagccaggagcctcctcttcaggctacaaccttccttcttaagggccacagagtttgtggccccacccccagcacagccccaccttggccccaggaaccctgggagtggccttggcttcctgcaggacagccatggacctactctggatgcccctgctgctggtggccgcttgtgtctctgctgtccacagctcaccagaggttaacgccggtgtttccagcatccacataaccaagcctgtgcacatcctggaggaacgcagtctcctagtgctaacgcccgctggcctgacccagatgctgaaccagacccgcttcctcatggtgcttttccacaacccatcctcaaagcaatccaggaacttggcggaagagctgggcaaagctgtggagatcatgggcaaaggcaagaatgggatcggctttggcaaagtggacattaccatagagaaggagcttcagcaggagtttgggattaccaaggccccggagttgaagctgttttttgagggcaacaggtcagagcccatcagctgcaaaggagtggttgaatctgctgccttagtcgtttggttgagacgacaaattagccagaaagcatttttgttcaacagcagcgagcaggtggcagagtttgtgatatccaggcccttggtcatcgttggcttcttccaggatttagaggaagaagtagcagagttgttctatgatgtgatcaaagactttccagagctaacgtttggagtcataacgattggcaatgtcattgggcgtttccacgtcacccttgacagcgtcctggtgttcaaaaagggaaaaattgtgaaccgccaaaagcttattaatgacagtaccaacaaacaggaactcaatcgtgtcataaaacagcaccttacagattttgtgatcgaatacaacactgagaataaggatctgatttccgagttgcacatcatgagtcacatgctgctgtttgtctccaaaagctccgagtcatatggtatcataattcagcattataagctggcatcaaaggaattccaaaacaagatccttttcatccttgtggatgcagacgaacccagaaatggacgtgtcttcaagtacttccgggtcacagaggtcgatatcccatccgtccaaatcctaaacttgagctctgacgccaggtacaaaatgccttcagatgacataacctacgaaagcctcaagaaatttggccgcagcttcctgagtaaaaatgccacaaaacatcaatccagtgaagagattccaaaatactgggaccagggactggttaagcagctcgtggggaagaacttcaacgtagtcgtctttgacaaagaaaaggacgtatttgtgatgttctatgcaccctggtctaaaaagtgcaagatgctgttcccactgttggaggaattgggcagaaaatatcaaaaccactccacaattatcattgccaagatcgatgtcacagcaaatgacattcagctgatgtacctggaccggtacccattcttcaggctgttccccagcggctctcaacaagctgtcctgtataagggagaacacaccctgaagggcttctctgacttcctggaaagccacatcaaaactaagattgaggatgaggatgagctgttgtctgttgagcaaaatgaagtgatagaagaggaagtgctagctgaggaaaaggaggtgcctatgatgaggaaagggttacctgaacagcagtcgcctgagctggagaacatgaccaagtacgtatccaagctggaagagcccgctgggaagaagaaaacatctgaggaggtggtggtggtggtggctaagccaaagggacctccagtgcaaaagaagaaaccaaaagtcaaggaagaactttagcttctccaataccaggaaaaaagatgcttattttccagatcctggcatcattttctgaatggattgattccaataaaagcatatatcattgtggtagggtaggtggggcgggggtaggggtggataataaagcctctgagtgtccttgg

SEQ ID NO: 5211 - DNA, 5417 bp, Homo sapiens
aatcgctggtcgccagcgaggggtgcggcttcaatttcaataactttattggtggcctgatctgcagaacagccatcacatcagtggcccttggaggagggagcgcatcgcccgaggtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaagctccctggggacaaagagtttgtatcatggcagcaggatttggaggactccgtaaagcccacacagcaggcccggcccactgttatccgctggtctgaaggaggcaaggaggtcttcatctctgggtccttcaacaattggagcaccaagattccactgattaagagccataatgactttgttgccatcctggacctccctgagggagagcaccaatacaagttctttgtggatggacagtgggttcatgatccatcagagcctgtggttaccagtcagcttggcacaattaacaatttgatccatgtcaagaaatctgattttgaggtgttcgatgctttaaagttagattctatggaaagttctgagacatcttgtagagacctttccagctcacccccagggccttatggtcaagaaatgtatgcgtttcgatctgaggaaagattcaaatccccacccatccttcctcctcatctacttcaagttattcttaacaaagacactaatatttcttgtgacccagccttactccctgagcccaaccatgttatgctgaaccatctctatgcattgtccattaaggacagtgtgatggtccttagcgcaacccatcgctacaagaagaagtatgttactactctgctatacaagcccatttgaagggatcccttcttgcctctaaggattcaggagaagcatctcccttgcatttctggactgaaccagtcttacctgagactggaaggctgatttgctttgaggctgatatgtgtgtttcagagcctctgagtaggatgctctgcttttgcatttgattgcagatgagagctttatgagttcacggaatttattttaagaaaaaaaaatatacatatgagaagaaggtaaatggaagcctcctagccccagctagaagtattgtttctgcctgtgggttttcaccaagacctgtttgggggcgctgcaggaataactatataggaagatttttcctaaaatgaaagaacagcaaactcttaggatccttgttgggtggagattctatcactgctaccttggctctccaaggaatgggcttgtgctagaccgctgccctacttaacagctgcctcattgcaagggcagtttttcttgcatgggttctctatattcccagagtatgtggcacaatctgtgttgtttatatgataccagatgccccacaagaacccttattcctctcatttcacattcttcctttaatagcctccttcagatcccatacctgacccctctctaacacaaaacttattgggtaagtgactttgaaaagttttgtggcacctgacccaccccagacactagggctatcagaaggtctcctttttagcccagcacaggcccaggccactttgtcgtgtttgttttaacttctaaagaaaatatgtttcagcattataagaaaggcagaatgcagaacacctacatttttgttttagtttggtgccaaggctcaggctgtattggcaaattcccgaaagttttcccactttgcctggccctgcttctgtcttttctttctcagtaaacagttctgaaggcaggagtggaacccgggagtattttcatgtctttcatccttgaaagatttttatgtgcctgcattttttttttaattaaaaaatgccttttcattggtcttaagagaccgcattggagaatttcaggcttttgataaatgcttcttcaaagagattttcttctctagtctagccttccacattcttagattaatatggccaaccctgtacacatcactacactaaacactgctctagataaactgctcaagttcatttaactcatttgatgcacctaaaggggttcctcattttaaagatttgttaggccaagaagcaagagagtattcctagtattcccaaccatgaaaagtatcattctttgcaccaaatgttaacaaaatcattttgttctcctgcctcttctttttaaaggtgtttgatgattaagtggggtcactgaattccatttgtggactgaaaagtattcaatccacttttggggttcagagataaaacattttttcccaagtagctggggctcttccattttgcagataagtcaaataatcaacactaaaggaggctaaactgttgatgaatgagagactccctgactgctcagatgaccctagccacactgaaagggcacctacaggtcagtttagctacctcctgtctttcccatgcaaagctgataacacagttgtctttggacttgtagacctcttggattccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaagattcaaaatcttggttattacatgaagtttgttatatttcttgtcaacagtattgaaatgtaatatgtatgtgttcatgtatgaaaatttttactccacacaggtgtttcagtagagtggggcaggaaaagagatctcttcgatttctttcaggcctgaggcttttgtgaaatgcgtcagccccctgtgacagtaggttttgatgctagtgatcttcagatctttctctctggaaatgtgcagagagtgtcagtttcccaagttctgaggtaactctcagcccagatgtgaaatgggagcctaccagctggtatagaagggaatgggtaggaggcactgggtgctgactcattcagcactgtcccttttctatactgctgatacatcccatggttctgagaagccttatctcagtctatttggaagagagggaggaagagaaggaagtaacccaaagtactactcatttatcattgtatattgattagttaaagggataattaatttaatgctgaggagagtttgacagattttgaaaatgagtaaaggcaaaaaaaatttttttagcctttattttgcttttgggaattttacagagtcaaagtaggcagaataagaaaatagttcttcaggagggccgacctttaaagaacttcaacatagtttcggaattgtggggaagagaagagtgactgagctgagaagtaataatagaataaagggttgagtaacttagaactgaaaatgatctcttttaaaaagaaattaaatcagacaccacatggtggtgtccttggatctcactgtacagaattagcagtgtataaccatcttctcttttcatcttgttccaattctctcctctttcctttccattctgctttaagctcatgtgtcaggcagactttaccagagtgtcagacattacctaaaacacatacgttagccatgctgctggtatggagaaattccacaccatgattattagcctcctttaagctgaatgggatttaaccattctaggcaacacccctgaagggcatacctaacctcaatagtgttggcttttaaaacgtatgtttgtatggtagagaaactttgtaaaagaagaatccaagagaagtttgtgaggatcctacaaacccaggcccactcactttgctctaattctttctagtatcttgtagatctaatgggtctgggataaaaactttgaaaagtgtcaatattccatgtatgctgctgaaatgaagttaagtttggaaagaagtgatacctctagactgggtttatattaatctgggatataaatgaagaagacatactaatagaactccttgcttttaattggggaaatagggctttaataattttgacctcaactaaaaatgatatgcaatagtctctgtgtgtgtttgaaatacattgtgttctcagagatttctacattctcacgttctagtgatttggggcatgggcttaatagcagatgtacagtgtattcctgcattattgtgattccccttaaagcccagttcttgctgtcttctaccaggggctgctgactccagttacccatggaatgcaggacctgggaggggtagccattagggtctttcaaaactctttggatctaagcatttgtctctccttaagtgccaatcacaattggatatggaaggactgtgatttctgcaatgaacccaaacttttagagtaaaaagccaaatttaaattataagaaagaagggaaaaaagagaaaaactcaagtctattacttgtagagtccaattcttagcaatggaatcgctctaggattctagtttgggctttgtctggatttgcttttctcagttgtgctttgaagtgaataagctttgttacaaattaattttttattagttccaatattagttggagttaacttgaattgattgtatgtagcacagcacttttgcagtaagattggtgtgaaatactaaacactatggattttgtaggtgtcaggttaaatggtcaagggatacctacattaagtcatatattaggtattgatgatcttacttcttttctgttcccctgtacaaaacacttacctaacccagcttgtggttttaggacagccaaagctcactgttgttggttagtcctaatcactacacgggtctcataaatgagacttgtttgaattttggtacattggagcatgttggttggtattacacggcagcatttcgaatgagtgcagctctgtgtctgtcagaaaggagagataagactactttgaagggaattaaatatgtgagtcctctttttaatggtgctttttgtaacctttaatgctgaggtacagagctgcttttcaatatttcataaaggagtggcagacaagagtggattttaaagctgttcttcaaacgtaatttgtcactggactctgacacacctggaaattatatgatatgatacatacagaaatgttgtgggttttttccataaaactttaataaaagtattatacagcaataa

SEQ ID NO: 5212 - DNA, 789 bp, Homo sapiens
acatcagtggcccttggaggagggagcgcatcgcccgaggtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaagccataatgactttgttgccatcctggacctccctgagggagagcaccaatacaagttctttgtggatggacagtgggttcatgatccatcagagcctgtggttaccagtcagcttggcacaattaacaatttgatccatgtcaagaaatctgattttgaggtgttcgatgctttaaagttagattctatggaaagttctgagacatcttgtagagacctttccagctcacccccagggccttatggtcaagaaatgtatgcgtttcgatctgaggaaagattcaaatccccacccatccttcctcctcatctacttcaagttattcttaacaaagacactaatatttcttgtgacccagccttactccctgagcccaaccatgttatgctgaaccatctctatgcattgtccattaaggacagtgtgatggtccttagcgcaacccatcgctacaagaagaagtatgttactactctgctatacaagcccatttgaagggatcccttcttgcctctaaggattcaggagaagcatctcccttgcatttctggactgaaccagtcttacctg

SEQ ID NO: 5213 - DNA, 1865 bp, Homo sapiens
gcgtgctggcccggggtggcaggagccgcagaggcttgggctgcagaaaaaggatcctgtttgctgtgtaatcctgagaatggactgcaagagaggaaaaactgggcgtctgcttgggaatctattgtggaaacccagggtgtttcccgaccagtccctgggcgccaactagagtatggactgaccaggtacctggatggagacctgagctggagaaggagatgcgcttgggaggaaattgcagaggccgtcaacatggaaaagcagccccagaacagcaggagaggcctcgccccccgagaggtgccgccagctgttgggctgctgctgatcatggccctgatgaatactctgctctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaggagctgtaaagagagtctttctgtctgagtggaaggagcacaaagttgcactctcacagctcaccagcctggagatgaaagatgatttcctccatggactgcagatgctgaaatctctccaaggcacacatgttgtcacgctgcttggctattgtgaggatgacaacactatgcttactgaatatcaccctctaggttccttgagtaacctggaagaaacactaaacctttcaaagtaccaaaatgtgaacacgtggcagcacaggctggagctggccatggactatgtcagcatcattaattacctgcaccacagccctgtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgacatttggaagatcccagacatctccagtttccttctggggcacattgaagggagtgatatggtccgattccatttgtttgatattcacaaagcatgcaagagccagactccctcagaaagacccactgcccaggacgttctggagacctaccagaaggtcttggatacacttagagatgccatgatgtctcaggcaagagagatgctgtgaaaaccagtccagccaatgaaggtgggattgaagggctgaatggaagttacagcattctactctgatggtggagttttttgcctgagtttcgtgttttattgttttttttatggcttagccatgtggttcgttgtccacatccacatgtacgtttgtatgtagtccacattggttgttagatttttttttttttctttgagatgcggtcttgctctgttgctgaggctggagtgcagtgatgtgatcttggctcactgcagcctctgcctcccaggttcaagcaattctcccacctcagcctcctgagtagctgggattacaggcacaccaccacgcctggctaatttttgtatttttagtggaggtggggtttcaccatgttggccaggctggtcccgaactcctgacttcctcggcctcccaaagtgttgggattacaggcatgggccactatgcctggccagttgttagatttccatggatttgtagtttccaaagtttctcgttattgatttctacttttcttccattgtggtctgagaaggtacttgatatga

SEQ ID NO: 5214 - DNA, 1507 bp, Homo sapiens
cttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagaggcgtgagaatcactcctgtgttaccttactcttcccaaggtgaaactggaagcagcttctagagaacagcttcaggtgcagaccgagaaatgacgtcatcctgataattattggacgtgtttattaattgcaccccattagcccctgtttttaaaaaatataggttagcaggacgtgggcacaggccgtgaaacatttatagggcgcctgtcacgtgtgagacatagtaatcagaggccaatggtgatgtgtgaaaatgaggatgaccagctctggttttctaggagctatggtctcataatgacaataatcagcatagtgtacttgtccttaatgttatagcatggcaggaaagaccatgggcttagaaggcagacattggttaggaggtgcagggaacatactaattcatgtgcggtcaaagcacttggcatttaatagggcaaaggtaaacagatgtagagaaatgagtctcatgcctgtaatcccagcactttgggaggccaaggtgggtggatcacttgagcctaagagatcaaggctgcagtgagccatgatggtacccctgcactccagcccaggttacagagcaagggcctgtctcagcaaaacaaaacaagcacaggccaaggagtgagatagccagcgctgatggtatctgcctcgtagtgcatgaagtgcatgtcatacactaagcagccagccagtgttggctgtcagtgttattactcacatgctttattttatttaagactttgagatagttcatgaagtgggtattattatcaatttccattttataggtgaggaaactgagcccagtgaagttaaataacttcccaaggtcattgagctgttgagtggacagctcaggtctgtttgtaaatctttaataaataacaacagctaagattca

SEQ ID NO: 5215 - DNA, 5235 bp, Homo sapiens
gctcgcgtccctccttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgaggagtgttccatagtttattgttttcctattatgagaatttaggccaagtgtggtggctcatgcctgtaatcccagcactttgcgaggccgaggtgggcagatcacttgaggtgaggagttcaagaccagcctggccaacatggtgaattatctctactaaaaatacaaaaaaataataataatagccaggcgtggtggcacatgcctgtattcccagctgcttgggaggctgaggcaggagaatggcttgaacctgggaggtggaggttgcagtgagccgagatggtgccactgcattccagcctgggcaacagagcgagactccatctcaaaaaaaaggagacttcatgtgcccccaatttttcactattgttatttgaaaaaatatttttatttgtaagagtttttctttatttaaaatgttcattaataaagttgttggacgggaagcaaaaaaaaaaagttgtttaagataaattcccagaagtgaatttgttagatcaaacacttaaaactttttgttatggaagaattcaaatataaataaaaaattgtgagtaataaaatgaactcacagtttcaacaatgacccacattt

SEQ ID NO: 5216 - DNA, 983 bp, Homo sapiens
cttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggact

SEQ ID NO: 5217 - DNA, 4825 bp, Homo sapiens
gccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggtgcctgcccacgtcactgtcggccgagagcgggtcgggtggctttcaaaggttcttctgtcccaagtactcggtgtcagagcagatggtcgcctgtgttcacagtggtcatttccatactgtttgcctcctcgtctgagtctcctgtagcatctggttcagtgtttccctgggctgaagttaattgttcatcttgcccctttagttctcatgcacagaattcctccatagcaggctgttggcatagctggcctcgtctcagaacctcttcttgtgtcgcattttcccatcattcccggtttctgcccctgtctgccccctgccctgagagttgcccgtgccctggacttgggcatgtccttgttgctgtgttgttgagcatccgtgagcgtccccgaggccgggagcgtgggccctcgtgtgatcattctcgtggggctgccatgagcgtccccaaggctgggagcatgggccctcgtgtgatcgttcttgtggggctgccgtgagcgtccccgaggccgggagcgtgggccctcgtgtgatcattctcgtggggctgccgtgagcgtcccagaggccgggagcgtgggccctgcgtgcagtcattcctctggggttgctgtgggaggtacgcctgggcctctgttcctccaaagacctgcctgcccatctgcataggagatgaaggctggggttagggtgaaacggtttgagttaaatggaaaatgaaagtagagggaatgatcttccccgtggttagcactgtgcacacgcgtgcgtctctgtgggttagtctgtctctctcctgcccgaggaatgctgagcgccctgagccggtgcctcttcacacatctgctatttcctgtggtgttctgggcatggtgtgtaagacccacagaggctccgggtgatgctgtctgctgggtgtgggtccctttccctgttaagcagacaggatgcagcgctgacttcttaggtcagggcggaggtgtgcaggagcccagttacgaactcacccctgcttctcaggtgtggccttgggattttgactgcgaccttggcggtgctgtctccgcagcccaggaagcctgctgtggggaggcttcgcactgagctctcagcctcctgccctcagctgcgcgaagcgctcggcccagctcactgaagctgccctgcctccgggccggcgcggcctgctctggcaggcccctgtgtgtggggtggtgagggtctccccaccagtgctgcaccccgcagcagcatacaggcctgtgtggcctgctggccctgtggctctgtgtacagcgctgtgcatgttacatttgctctggaaacatctctggggtttgcttgttcacgaagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttagtaggaatctctcattgttcaccatgtgacccccaggaggtattcgacctgcactggcgtgcctggcctgggatttggtgacggagaggagggctcccagggggacatgcggtgggacaggagcgtggcggctgctgactgtggggtgtggatggggctgcagcaccaggcagagcccctcagggcgccgatgtcgagggcacctgagcgaggggtgccagcaagggggcggccggctggtgggtgctcgggggacggccgtgttggttccatgtaactgtggaactcatttcactcagctgctcctctcagttctccctgactctggaacctctgtgacgccagttctccctgactctggaacctctgtgatcctttgcaggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaagttggta

SEQ ID NO: 5218 - DNA, 2871 bp, Homo sapiens
gccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaagttggta

SEQ ID NO: 5219 - DNA, 3533 bp, Homo sapiens
gtgctgcggctcccgggccatctttgtgcggggccgcgcttccgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactgtgttactcaggaggtttctataatgccacatagaaagaggccaattgcatgagtaattattgcaattggatttcaggttccctttttgtgccttcatgccctacttcttaatgcctctctaaagccaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaataagcagatgtttaaagttggatttttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacacaaa

SEQ ID NO: 5220 - DNA, 4958 bp, Homo sapiens
gggcgggcgggccgcaggctgtcgggctggggctgaggctgaggctgaggttgaggcggcggcggcggcggccgggtgcccgggacagcgacgcagcgcgccggcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcggccgagggcgtcgcggactctccccgcgatgatgccgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggacgccgctgcactgcgctgcctcttgtaacagcgttcacctctgcaaacagctggtggagagtggtgccgccatttttgcctcaaccataagcgacattgaaactgctgcagacaagtgtgaggagatggaggaaggctacatccagtgctcccagtttctatatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 5221 - DNA, 2566 bp, Homo sapiens
gggcgggcgggccgcaggctgtcgggctggggctgaggctgaggctgaggttgaggcggcggcggcggcggccgggtgcccgggacagcgacgcagcgcgccggcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcggccgagggcgtcgcggactctccccgcgatgatgccgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccccctttctaccagcccagcccctcccaggacttcatgggcaccttggccgatgtggacaatggaaacaccaatgccaatggaaacctggaagagctcccccctgcccagcccacagccccactccccgctga

SEQ ID NO: 5222 - DNA, 3473 bp, Homo sapiens
tgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccg

SEQ ID NO: 5223 - DNA, 3473 bp, Homo sapiens; identical to SEQ ID NO: 5222

SEQ ID NO: 5224 - DNA, 2722 bp, Homo sapiens
ccaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 5225 - DNA, 2273 bp, Homo sapiens
gtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgg

SEQ ID NO: 5226 - DNA, 4513 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggaacctggccactgctccttggtccttggcattatgacgggattcccttgtcacctctgacagttcctggctgcggtgtccgcggactggctggggagtgatgacagaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagtatgtcataagata

SEQ ID NO: 5227 - DNA, 3222 bp, Homo sapiens
gggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagaagggatggaaaccctattttcttttctccaagaccatggttggtctgcttccctcactcgggctccttgacagtcttctagaagagagaaggaggaaaagaagcagttcctgatgttacaaatgaacaaggatctcccagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccct

SEQ ID NO: 5228 - DNA, 2351 bp, Homo sapiens
agttctgggacaacaacggcggccgtgactatgctctacgtgggcccgagcacccgggcagtggcggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagaagggatggaaaccctattttcttttctccaagaccatggttggtctgcttccctcactcgggctccttgacagtcttctagaagagagaaggaggaaaagaagcagttcctgatgttacaaatgaacaaggatctcccagaactatgactcgatcataaaatctgttttgtttgcatgcatgcccaaaacaaccctgaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctc

SEQ ID NO: 5229 - DNA, 1187 bp, Homo sapiens
gagcacccgggcagtggcggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgtcctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataa

SEQ ID NO: 5230 - DNA, 932 bp, Homo sapiens
aacggcggccgtgactatgctctacgtgggcccgagcacccgggcagtggcggagctccggagccgcagggctggatccactttatctgagacgaggcgcctgcggccgacggcggaaaacaccaaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctg

SEQ ID NO: 5231 - DNA, 690 bp, Homo sapiens
cggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaa

SEQ ID NO: 5232 - DNA, 3421 bp, Homo sapiens
cgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccagatgacacttcaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgagaaacagtgtcttgcggtgtagtgttctcctgtttgggcatgagtgtgcagggtggtcactttctgtgggaggatcacagtggggagttgggggtgggacgtggtcgcctgctgctgcttcaacatgtctttccttgaagatgtgtgtctcctcgtctcgtggtcctaatccatatggttctttgtcttttccacattctgcctgtgggaccctacaggtgtgtatttggatggtggtggtgggagccagggaggaagagtggcagccacatgagggtttggtgtcagtcacatggttgcagtggtagctgtggtctcctgtggatgtggggacatcagttgtgaatcagccacaaggttttgaggttactgaaaaaacagcctttgacaccagcagggagaccccttagtccctgagataaggaaggcctcagaaaggaaagaggagttaatgtactgcagtacttggtagcacagttgctgtccacagacatcacatttctactaaaaacaggaagcccagaagctttgaaagaaagatatatatttattgcatgcaaataaaaaactgctcaacaaaataaaa

SEQ ID NO: 5233 - DNA, 1885 bp, Homo sapiens
gccgtcggtgccgccgccgccgccgatatggcgcgtacggcccctgtggagcccccgctgcggcattccgcgcccccctcgccggccgcggctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggagcatcctgatgtccaggagtcagtgggtccactggtagcccccacccctctccgtccatggccccagatgacacttcaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacaca

SEQ ID NO: 5234 - DNA, 1713 bp, Homo sapiens
aatgtattatgatgtaggggagggaggaaggagggccagggtagggggcacaccctctccctgaatgaaattcatttaggggcactgtctgctcgcatgttctgttctgggagaaaatgggtagcagaagctacaatttgtactaagctaatgaaaagagagaaaagaagaatggggaagagaagggcaaagaaggcaaaaagagaagagaagaaaaagggaggagagagaaggagaaatgagaaaagaggaaaccaaatgaagaggatgtgtgagagaaaaaaatatgaaacagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagc

SEQ ID NO: 5235 - DNA, 4125 bp, Homo sapiens
ctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggattttaaataaacttggagccttttcttgaaagacagctggctgtggagagccttctaccaactgcagttttagatacgttttgaaaatttcatcacctgagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgtttgataccaatcataatcagtctgatactagaatcatgattggttttgttctttagtactgtctagagctactattttgtttttattgctgtccgccacttgatagtcatacatctagtatgtgtttgtactatttagtattgcattcattggacgtactattcaacgaatttgtctccttactgttaccaagggtcttggaatttttatattttaaattaatcattcaatataagttatttataggtatagtacaattttaaaatatttagaatgctacaatcattggttcaaactattgattcatgggaaaatttaaattcataagaataatatgtatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaaa

SEQ ID NO: 5236 - DNA, 8184 bp, Homo sapiens
cgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaacttaatcatgtatgtgtaattcctcttttaccctggccttttaaaacactgtgccgttgtaatgagacgtttctcatagggaaagatgttagtctcttttaattggacaacactgtcactcaaggcatagatgaaactttccttccattagaaagactaaaagatttaattcttggttgtaccttaatctattttttaaataggtttctttcaggctgcttatttttcattaagatgtgtatcagcttggatttgcctactgtttaattaaaatatttattgtcaaagtttgacaatctaacactctatggtaggggtgtgtgtgtgtgtgtttgtgagtgtgtgtttgcctgtgatttttaattggcccatgtctttagaatccaagtggttaagatgtatttgtgatttgaaatatagcatgttgataatatttagctgttggcctttacaaataactttcaaagcttaaggaattgtagatataaaaataacctaatttaatttaggcttaaattcctctgattaagcatgtgaaagtaagttttaaaatctgtcgcattgaaaagattactgttccgtgcccttctgtatttttgtctctttaggttgaatattgtatttatcaccatgtaatcattcagtaggcagattcccactagaaaactgttgaaatgtaagactaaaatacaacattgaatacaaaatcaaaattttgtgtataaaaaccagtatagtccattttgttatatttgttttttccctaacttggaaatatacatatttgtatatatagccttaaaattaatgtaaagttaggggagtagtggggaaagtaatgtgaaatgtctcagatttaagtagttaaataccagcaaaatcttttcattatccctcttattttgtgaggtgattaaatgtaacttaattgtatttaatttatatcttattccagcatgaatgaggaaaaactgaagtactatttatatttagaaattcatatcagttgaaattacagaaccaattccatacttacaataaatacttaatgtctaaatctgtggtagagtgcgaagtatgataatgttctaagttatggctttgcaagcatctaaatgtgcatttaatgaataccagtgcttctagtatagactaattaccagacatactggtactgaaagctaaatccctattataacaaaccagttccttaatattttaagtagactgacaactttagttccagaaattgcaaaactttgaactggactgtgtaatcttttgagatgcaaaacttaagtcacaagtagagtatgtgatggaaagctgtatttcaaaccataacagcatatttagagccttttttttttgagtctttaaacaagagaaaattaaaatattcctgtcaaaattattagtattgaaattaggcttggacacgagagagaaccgtatttgagtgatgtgagaagactaaatcttttccacatgagtcagcactgccatactaataatttttttactataaaaatacaggaaggaagtatacattataacagcagactgtgtgtgttcctgattcctggaggtaatagtggggggaaaccaaccatactttttaaaggcacttttgcacctctattgtgcacttcattcttgtaccacttaaattcttcacccccatcccctttttttgtgctaattagcatctcagggcaatgcctcaaaaatgtttgatgtgttctgttctttggagggaaaaagttcttatgtgatgataatatagtactcaaaatatacttttatcatttaaatgtcttatttgctgctatgaataggaaataacattttgtatagcaggctctgttttaccctaacattaaaaaatttcactgatctttctttcattaacagggtagaatctcctaatttccactttcttgggaatatacttttatagacaatagaagcagttctcaatattagcatatactttaaaaaatcaaagtgataacttaattcagctttggaagtatctcaaacatatttttactttatagtgcattaacttgcttctagagtacttaatgcaactgctctagccacttaattttttatactaatctcaacattaagaaatttggattaagtaataaattagttatgtaattcaagtaatctgaattacagcagtacttttagtgatcattcataggactatatattaacccagctaataactcagtttttttacaaaatgtttcgagtattattggtaaaacactgttctaggctaagcacattgggactgtaaagaaatgagtagatccttggcttcaagtttacatctggacaatttataatctagtgtatgttagtattataactggatcactcatcaaaaaatatatatatatatctattgcccacctgctatctaccaggtacttagctgatcaaggcaggcccctgccctaaagaccttgtttatacttcctttactcacctgaaaactgttctccagtttattttcttctctctaaagttaaagagtaattcagaagaaaattttgcttagcataagaataaaattggactgaagaggcttaagcccattcagtatccttgattgcatttatccaacggcctttattcttcctgctgacagcagtaactcagaggaataggtagtagatttctgaaaattatccagccatggaaatgtaggtggggtttgagtttaaggcatttaaaaatgtaaatatctctagctaaatttatcttaagtagaactctgtgtttttgtaacacactgccagtgttaatatcaaattttagccaaattattactatgtgttttaatattttaaaataatttcactgcccatctttactggacaaactcatttggagttcaacttgtgatttctgaaagaactgatgaaattgggtactgctttttttctccatttttcgttttgttttaattttgaatttcatggtatatacttttagttcaaactcagctgtttgtacagtattgtattaggatttggtattagaaaagatgtgtaaatatcttagtatataattgtttctcatttgaggtttttcttctaagggaccttaaagagttttatatacttttgctcacagaaactgctggtgagattaccattttttgagtatctagtcttctagtttttcttttaggcattaggaagccttctttagagttcaaaattttagaagcctaatttgctcttacttccttcaattatgtgccatgtgttttggtttgtatatgttttaaattgtatatttccttggaatatgcttgaaatatttaagaatacattttcaaaatgtataatactgtattgttttgttgatcagaataataagtctcagttaaatgtttgttattactgatagtcaaaatgctcaatagaaatgatgagaggcattggttccaattcattgtcaaatgaacgttttctaattttgttcacagattctttccctttcgattgttctgtatgttaagatagtggcttctgctctcactgttttcctatttatattactagcaggtaggagtgctaattagaaaaacttagatggtattgaaattacagttgacaacttatatttttatgagatggagaaaaaagattaagttgatataacaacaaagtggactttttttcttccttatcctgcacgaaatattgcccttgtttcctctactttcctcttggtgttttctctttttttcaaacagaaacaggccaattccattttcttgagcaagaaagcttagtgtgttacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatgaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagttagattgatgtaagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtggggaaagtgattaaaaggtgaaaaaaaaacatagtattcagaagttttggaggttaatgtctttctctaagatttgccactttagaaattcaacagaaaagaggtaaaacagaaatggaatgtatctggaacatttttggcctccatagtgcagatatactatattaacaagtaatacatttatttacctgtcagatctccaggttttaagattttgagctttctagtattaggattcattaaatgttcaattcatttcatattctaaggaattaggttatttacttactaattcaggatgttaaaataacatccaagtcggacaaccaccaccaatgcacacagttaatgagatttctaaaatataataagtacaatgtaacaaacgtatagaattttgcatttgttgccaaaattagatgtttaatgacagcttatttaattcccatttgtgggacttctggaacatagaaaccattatcttacctggttatcccttgactaaatagcatatctgcaggaaaatatcttgtttgtagtgatatgccccaatagtgattgatttcactcttgaaatgagttatatcacttaatttgtataaatgttatgagtggagagacatgtacatgttaaaagcatgttgcattatatattcattttttaaactctataaatgttaagaataatataattgcagaaatatttttcttaaatacaatgtgtaacaaaattctccgtagcaactcacccactttgcagtttatgtgatccacacttttaaagaaattccataaatgtatattttgtattatgtattatttcctggtccaaagaaaatatgtgaattcagttctaactttaagaatgtactgtttgttttcaagttcattgaaaaattgcattcagcctgcgaatggttgcagattgtatgttagatgaaaagtagaaataatttctagtttggaaaactggtgccactaaataaacaggcaattacataa

SEQ ID NO: 5237 - DNA, 854 bp, Homo sapiens
ccttctaccaactgcagttttagatacgttttgaaaatttcatcacctgagggataagagttggtgtccttgttcttttttctttcctgggaattgttctagtactgagatttcctctttggcttgaagtttctggtcttcactctagcactaattgaaaaaaaaaaaatttgttttccgagaactgttactttcctccatattttcaaatttattaacagagaattgtacagagtgatttattttacaacaataaaattctatttgtgagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaa

SEQ ID NO: 5238 - DNA, 564 bp, Homo sapiens
cgcctgcggctgctccggtactttgttttgaaaagttcagatcaactgataatactagtgctgtgatgagactcagcttgtactcaagaacagatttatgactagcttatagttggctgcttcaccaggactctacaaattgctcagaacccaaggagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagc

SEQ ID NO: 5239 - DNA, 1546 bp, Homo sapiens
attatgatgtaggggagggaggaaggagggccagggtagggggcacaccctctccctgaatgaaattcatttaggggcactgtctgctcgcatgttctgttctgggagaaaatgggtagcagaagctacaatttgtactaagctaatgaaaagagagaaaagaagaatggggaagagaagggcaaagaaggcaaaaagagaagagaagaaaaagggaggagagagaaggagaaatgagaaaagaggaaaccaaatgaagaggatgtgtgagagaaaaaaatatgaaacagtactttgttttgaaaagttcagatcaactgataatactagtgctgtgatgagactcagcttgtactcaagaacagatttatgactagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaa

SEQ ID NO: 5240 - DNA, 569 bp, Homo sapiens
ttatttgccaagagtttcagagctattaacagaagcctaatacatgttcttggactttgcagaaataatttgttgatccatgcggtttcattgctactgcggaaaacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaaga

SEQ ID NO: 5241 - DNA, 5213 bp, Homo sapiens
gaagaatatctctgctatgggcctgtactgtggtcaatacaaagatatgaactttcccgtcttctccaagagcctatcttcagtgcttcagtactgccagcaagggtgcatccagctatatgtcagaatggttttcaagctggacgaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctggtgggttctaaaatgatcagaagagtcagaagatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggtaaagaagacccagtgtccctggaatgctggcacactgcttacccaactactcctaacatgcttaccttgctttcctgtgcctgagccggggcatctccaggaatgggatgctcttgcgggaaactgggccatgtaccccctggattaggagggtgcaggaatgggtggggctcttctctgaaagaattgatgctacagttgtgtttttcctgagatgtcaatgtctcatctttagcaacaaaattcacttttttctttctgctttctccacaaggccttgagccatatcctagccccacggccttggggtctgacactagacttgactgaaaggggcctagggtggccacagtcttaaacacaaaatctgattgttttattccaggttattcttaatgattccgaagagcaagaggagatgagaagtttctcaggacccttgattaggtatagtgctgtaagagctgctgagtaagggcttttgaaacctagaaaatcttcctgcccagatcagcattttggagatttgttcttggtttccttggaaaaaaatatctgtccttgttggagtggaattctctgtgctgcaagatagaaccagatgtggcctgagtcattttgacaagccattcaatagttgaaggacagaaagaaaaattagcatgacagtttagaaatctaaaaccagttccattatgcagaggctgcatggttggaagttttagcattccgtgtgcttgatagatgttagtagaaaagtggagcatcgcctgggaagtcactgacaagtggatcatagcagaaacaattcttgtaacagtggctttttcctggagaggtaaataagatcggcagtgttcaagttacagaacagtgtgcaagtgagccctctgcagtactgaactaggactgcttttaaatgtctagttatatttctgataaatgtaactcagggcatctttgttgaggagagagtccttgctggatgacagcccacgtgggtctcaggctcaggcgtcttactgactaggaataccatggtggacaggtcagttagccctctctgaaccttagttttccccttgagaaatggtataacacctgctctccctacccgaggcttgtctatgagtctcaagtcagattatgcacatggaaagtatcatcactactatataaatgtattcctcaaatggcatttgacggttccctcaagtaaaaatgagtgttatctctttcttacaaacaggtatacagatatggggcaaaaaagcgagttgggtattcaaacactggggtactaagcctaacttggctttgatgttattggataatcttgagcaaatcataatgccaatcatattgatcacttaatatatgccacacaattttctaattcctttttgtatggaggtaggtccttttactgtccctattttaggggacaaagctgaggctcagaggaggtaagaaacttgtctaaacagagaagtggcagagccagatttagatccagggttgtctgactccaaagtctgcttttacttgctttcctgtgcagtgacttcaggtctctgagcctctgtttcttcatctataaagggggtgcatgagagaatctctgaaatttcttcttgttctataagaaaataactatcctatagctatagactcattaccttagccctggcttgtcagatttctatctcaatcacagcccagccagcacttgcacacttaggaggagcctggggtccgaaacagggaagtgtctgcctgctcactctttgctccctaaattttttccatgtagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagaccacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgagcaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctatcagcgtcgctatcccacccagccatgctgagaataaacacacgtcccaggctcatctcccaggactga

SEQ ID NO: 5242 - DNA, 3985 bp, Homo sapiens
cgctgaaggaaggtgggaagccatcagagcaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctgatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagaccacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattagcttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatgg

SEQ ID NO: 5243 - DNA, 2803 bp, Homo sapiens
acgagaagtgcaagctggcgatgcagaggggtgcgcagtccagcgtgaactacagtcagggcagcctgaaggatgcagaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagaccacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgagcaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattagcttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttc

SEQ ID NO: 5244 - DNA, 1014 bp, Homo sapiens
ctccgaggccgccgggccctcctccagagtcccgccagtcccccagagtccaggccagtccccgccgtcacccggtgcgagcccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccaggtgagccgggccggggagcccgggcccctgccccgtccccgccgctccgtccctgtcgggccgctggggtctccaccgtctttgctgagccacctctttgcctcggcagctggtacaggacgagaacgtgcgcggggtgatcaccatgaacgaggagtacgagacgaggttcctgtgcaactcttcacaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaata

SEQ ID NO: 5245 - DNA, 3782 bp, Homo sapiens
agattctgcacaagctccatttatcgttggttcttgcttttttccttctgtgtttttaattttttaaaaaacattgtatgttctagagaactagcttcacaaaaggtcggtggctgatgatctttcagctaagatttcaaatgtagaagaacaattcaaaatgctatcactgtgtatgtaagaaggatggggcagatttcattttaccctctagtctccctcaatgcatgcacggatttatctgtacgctaagctctctgctctgcatctgtagctccttgtggattatattgtctcagtgatcagaaatgattttctcggatatgaacaccgtttctggctcccctaaagtgcatcctcctaatgggacccggttttacacttttcaagaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaagg

SEQ ID NO: 5246 - DNA, 2976 bp, Homo sapiens
aaataactccaatgttttgctgatgcttggatgtaacaggcctttgtagctgacacatttcaagcaatgctgttcagctgcctgtttgaagaaagtttattttttaaaaactatgtttgcagttggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaacttgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgttt

SEQ ID NO: 5247 - DNA, 4033 bp, Homo sapiens
tttttccgatggacgcttctccttttggctgctgacggagccacgggaagatgccgagctcctgccacgccaccgggccggggcacgttccgggagggcgccggggcacgcgtgtgtctgagctgcctttctcctcccgttgctagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcag

SEQ ID NO: 5248 - DNA, 4727 bp, Homo sapiens
aaatttgtaatatgccatttttccgatggacgcttctccttttggctgctgacggagccacgggaagatgccgagctcctgccacgccaccgggccggggcacgttccgggagggcgccggggcacgcgtgtgtctgagctgcctttctcctcccgttgctagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaacacatctgggcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggacc

SEQ ID NO: 5249 - DNA, 5512 bp, Homo sapiens
tccgccccggggctccagctgcacgcggggagctgcggctgttctggcaaaggggccgcggctgctttaagagccgcctccccctctcctcctttgacaatggtctgaaccgagctttgcttcccaaagcaaaatttgtaatatgccatttttccgatggacgcttctccttttggctgctgacggagccacgggaagatgccgagctcctgccacgccaccgggccggggcacgttccgggagggcgccggggcacgcgtgtgtctgagctgcctttctcctcccgttgctagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaagcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggaccaagaaaaaaaaaaagataaaaaaacttctttactaagaaccacatgttcattcaaatatcttgaaatgccagccagtactggacagtgaatgtcaaccaccgcagagtctgaggctcatttccactagagaaaacgaaacccaagatacctttcccttttgtcaatgtaacagggcattagccagactcatgtctaatgttataagcttttagccgagatggccttgttgcgacttccctgaagtcagttttatcagaggaaataaatgaaagacagaatgattaacatatatagtgtataaaagtatagaagagtaatctcttccctgtggctttatttggtggtgttactgttgtttattctttgtttatatgggagattcaaagtaaagcctatttaataataccatttatctaactgctgattttctgctgcttgatcttattaagcgcaagacctgtcattagtaatttcttttctgtattttaatttgctatgtttgcacgtacattacatttgttttgatgtctatttttatttaacagattcagtcaaaaggtaatgataacagaaaccctttccattgtcaataaaaaaaataataattcc

SEQ ID NO: 5250 - DNA, 3976 bp, Homo sapiens
cgatggacgcttctccttttggctgctgacggagccacgggaagatgccgagctcctgccacgccaccgggccggggcacgttccgggagggcgccggggcacgcgtgtgtctgagctgcctttctcctcccgttgctagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaagg

SEQ ID NO: 5251 - DNA, 2037 bp, Homo sapiens
aaacagtaccaggcggttacctccaggtgactaaatgaggcttcatctcagcacacaagcttagaaagctttacgattagtcctgcttgctatggtaaggaaataacacaaagaagagtgcaaatggaagtcgacttcatcacaacatgcagtcaatttccaaacagacactgcaaatggatgtaaacaagctgaacataaccttgcttcggatcttccgccaaggagtggctgcagctttaggactcttaccccagcaagtgcacatcaatcgcctcattggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacag

SEQ ID NO: 5252 - DNA, 768 bp, Homo sapiens
gtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctga

SEQ ID NO: 5253 - DNA, 2821 bp, Homo sapiens
ctcagacggcggccaggtcgcgccgcgagcgagcttccgcgccgcccgcacgcgcgacctacctgggcgctccgcgcccccggatgctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaagccatcaggaagcagttaaaaggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagc

SEQ ID NO: 5254 - DNA, 6710 bp, Homo sapiens
gacggcggccaggtcgcgccgcgagcgagcttccgcgccgcccgcacgcgcgacctacctgggcgctccgcgcccccggatgctgcagttacaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaagccatcaggaagcagttaaaaggaggtttcccctgtaccctgcattttcgagtaagattttttatacctgatcccaacacactgcagcaagaacaaaccaggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaac

SEQ ID NO: 5255 - DNA, 2093 bp, Homo sapiens
aggtgcactgacaatagacatgtcagggggtcaagttagtgactgtgctctgcaagtgggatgaacagccagaaaagcagcccccaccacctctgttaggtgggagacctcttcctgccggtgggaagccactttgtgctgggtcttcagaggaggctggccctcctgagggtctgggaacccccattgctccaggagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcaccc

SEQ ID NO: 5256 - DNA, 6716 bp, Homo sapiens
atgctcagacggcggccaggtcgcgccgcgagcgagcttccgcgccgcccgcacgcgcgacctacctgggcgctccgcgcccccggatgctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaagccatcaggaagcagttaaaaggaggtttcccctgtaccctgcattttcgagtaagattttttatacctgatcccaacacactgcagcaagaacaaaccaggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgt

SEQ ID NO: 5257 - DNA, 8765 bp, Homo sapiens
gaagggtggtatcccgttgtggagtagaatgtaactatgaccttctgggatttgggcaccagatttatcttactgcaacaggagccatggtgggagccacccccataactcttatagagctggtgggccaccaggactgccagatatatatatatattttttgaaacagggtcttgctatgttgcccagactggcctcaaactcctggactcaaaggatcctccctcagcctcctgagtagctgggattataggcacataccaccacgactagctgccagatcatcttatcttggaccaggcttctaccattaattcacatgctttaaaaaaattaaaaattaaaaaaatgaaaaataaaaaaacttaaaagattttacctatattcctggaacatagttatcttaccccagctttgtagttcctgtttaaggaaattccctctgaaggaaattttagctctcaagagtcaaagaagatgtatagaggtggtatctgttagtttttgtttgtttgttaaggatctaggcagagaggtcattacatttttctgaagttgaggtcacaggtggggtacccacaagagaggtcattacatttctgaagttaggcatcccaggcatctcttctaaagaactatcctgtattctaattgttaaataaatatcttcttcattgtgagcctccacaactgctgtttctgataaatttagatcattctttgcagaattttatatactggcaatctcaaaactaggctccttcaagattcctaggaagtctcccaagctcgggttgggttccactattctagtttctttgtgtatgatgccatggggttgactcagaaactttgctcaatatatgacaaggcagcatttggtgagtggtgatctccacgtttatcttctcatttatatccctaggaagacatactgattagctgagcttgtcaatgaaagcccgggttcaccattggattatctataactctcctttctctttttttctctcagtagcattgtaggaggagagaacacttaattctggttgaatgtcagcttggataaacatagaaacaaactagaaagaactgatgatgttctcctaggtggaaaagatggagattccaataccaaataggtgtgaatcagcaaatgtatgttatactgtctctcaaggccaggtgttcaatacattgtgggtagttaattataatcaaagtaataatattagagttacgacatggatcctaagctttttagccattaaacatataagaaatttgtagcatagtgagtttttttataacatgatcatccaggttaaaataagacacaattgacctcacatatcctatctgagctccgattttgtcatctgtaaaaatggagatagtggtacctaccttacagagttatgaggctgagataagagggaaagttacaaagtagtaccatgtacaaagcccggaactgtgcaaataggaggttgtaatactgtttgaagcattcccatctcaaaaagccagttccttggcctttataaatttgaaggaataatgaaactgatttgtttcaattgtgaaaattatttctctcctgcccctgtgcacttctgccctgtctatattagatttcaagaggtttcccttttgtcatcttggccagacaatggaatgtctatcccgtttgaatctgggtttaaaaaagcatgggagctagtggccaagtgtcacatgtatgccgcatccctaaatagaagtctccccagggcgcttcctgacctgcgcaatgctgccgaaggcctcctttccccgctccccaggcagaggagcaaagtcacaggctgaggggcctgccacgacttgcccacaaaacaggtctggagtttggaagttacatttgctggttgcccagagatgagtgcagaattcagcttggaggtcctggaaacttctagtttactgatgtttatgcttttgctcatgcacccacagttcctgggacacagaatgctcacctgggggtttgtaccccagccaagaaggtgtcttcacagactcccctccttttagcaacttcatgcagatggagcttgggtggatggatcctggcacagtgttcagaacagtggccctgccagtgtgtgggcgccgcttgtgcagagcccctgtgggttctggtcctcaagggcaggggcgctcactgacagcggaacccatagtaccagcccatctttggtgggctgtttccaccccattcatccctgctcagctcttcataggacagcctgtgctggcagaaaattgcccccaccagtcaagacgtagggcatcaacatgagccatcagtaatgacagggcagctttgcagagcgtaaggtagcacctgataccttggaccaaaaccgtatttttatgtatctttcacatgtacagctcttgtctttgactcatcaaactttcttttttttttttttttgcttatttcagtttgagtatgaattaatgaaaacaattgtttcataggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgt

SEQ ID NO: 5258 - DNA, 8630 bp, Homo sapiens
gaagggtggtatcccgttgtggagtagaatgtaactatgaccttctgggatttgggcaccagatttatcttactgcaacaggagccatggtgggagccacccccataactcttatagagctggtgggccaccaggactgccagatatatatatatattttttgaaacagggtcttgctatgttgcccagactggcctcaaactcctggactcaaaggatcctccctcagcctcctgagtagctgggattataggcacataccaccacgactagctgccagatcatcttatcttggaccaggcttctaccattaattcacatgctttaaaaaaattaaaaattaaaaaaatgaaaaataaaaaaacttaaaagattttacctatattcctggaacatagttatcttaccccagctttgtagttcctgtttaaggaaattccctctgaaggaaattttagctctcaagagtcaaagaagatgtatagaggtggtatctgttagtttttgtttgtttgttaaggatctaggcagagaggtcattacatttttctgaagttgaggtcacaggtggggtacccacaagagaggtcattacatttctgaagttaggcatcccaggcatctcttctaaagaactatcctgtattctaattgttaaataaatatcttcttcattgtgagcctccacaactgctgtttctgataaatttagatcattctttgcagaattttatatactggcaatctcaaaactaggctccttcaagattcctaggaagtctcccaagctcgggttgggttccactattctagtttctttgtgtatgatgccatggggttgactcagaaactttgctcaatatatgacaaggcagcatttggtgagtggtgatctccacgtttatcttctcatttatatccctaggaagacatactgattagctgagcttgtcaatgaaagcccgggttcaccattggattatctataactctcctttctctttttttctctcagtagcattgtaggaggagagaacacttaattctggttgaatgtcagcttggataaacatagaaacaaactagaaagaactgatgatgttctcctaggtggaaaagatggagattccaataccaaataggtgtgaatcagcaaatgtatgttatactgtctctcaaggccaggtgttcaatacattgtgggtagttaattataatcaaagtaataatattagagttacgacatggatcctaagctttttagccattaaacatataagaaatttgtagcatagtgagtttttttataacatgatcatccaggttaaaataagacacaattgacctcacatatcctatctgagctccgattttgtcatctgtaaaaatggagatagtggtacctaccttacagagttatgaggctgagataagagggaaagttacaaagtagtaccatgtacaaagcccggaactgtgcaaataggaggttgtaatactgtttgaagcattcccatctcaaaaagccagttccttggcctttataaatttgaaggaataatgaaactgatttgtttcaattgtgaaaattatttctctcctgcccctgtgcacttctgccctgtctatattagatttcaagaggtttcccttttgtcatcttggccagacaatggaatgtctatcccgtttgaatctgggtttaaaaaagcatgggagctagtggccaagtgtcacatgtatgccgcatccctaaatagaagtctccccagggcgcttcctgacctgcgcaatgctgccgaaggcctcctttccccgctccccaggcagaggagcaaagtcacaggctgaggggcctgccacgacttgcccacaaaacaggtctggagtttggaagttacatttgctggttgcccagagatgagtgcagaattcagcttggaggtcctggaaacttctagtttactgatgtttatgcttttgctcatgcacccacagttcctgggacacagaatgctcacctgggggtttgtaccccagccaagaaggtgtcttcacagactcccctccttttagcaacttcatgcagatggagcttgggtggatggatcctggcacagtgttcagaacagtggccctgccagtgtgtgggcgccgcttgtgcagagcccctgtgggttctggtcctcaagggcaggggcgctcactgacagcggaacccatagtaccagcccatctttggtgggctgtttccaccccattcatccctgctcagctcttcataggacagcctgtgctggcagaaaattgcccccaccagtcaagacgtagggcatcaacatgagccatcagtaatgacagggcagctttgcagagcgtaaggtagcacctgataccttggaccaaaaccgtatttttatgtatctttcacatgtacagctcttgtctttgactcatcaaactttcttttttttttttttttgcttatttcagtttgagtatgaattaatgaaaacaattgtttcataggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgt

SEQ ID NO: 5259 - DNA, 10300 bp, Homo sapiens
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggccggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattgcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgtgggagaactgaagtccaatcagttcagtatggcaaagaaaaggcaaataaagacagggtatttgcaagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaaaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctggtcttttgcagtggtttgcgtacttactatactgattaccagattttatttttaaaattttagcaatatcgttcttaatattagccaatacactgcctatggatgcagcacatttttccctgcacaccccctgtagagacctgcctgctgctcagaagaagaaagatggaatttgctgttcccaggaaatgctgcacattgtccatttaccagcatcttatagaaaatataaatatgaatctacaaattctcttggatttaataatgtaacttatatttatcataaggttggcttattccaaatcatgtgatttcacatacttgatgtaaaggaatgcatgcattgtgtcttaaccccttaagtgccttgagacgtccttgtatgtctaacgaaaaggcactcatttgaccccactaggaggtatatatgtatattgtacattcgtatatttttatgcattttgaataagttcacattttaaaaaacagctatattgagtgttatacagtcaaagaagggtaaggaaattctgtttcttactcagtactcgtgatttgctataagaagcaaagataatttgtgttctactgagtgcacactgctgctatggaattgttcaaaatctgcacattcctttacttgagggactgaggggttacggtttagcagctcaactttaaaagatgcttttatgcttcaaatttcatatttatttcatccctaactttaggaagacatctaacatgcagattaatgttaaacatattgataatctaagctaaagttagagcaaataattgtgatttattcatgtccataactaaaatattattctttagcactcatttcagttaatatcaagctttgttcacactgatatattgattgggattcttcaaacgaagaatgaaacattattgacttatttctaagtgtaataactcaataactaaattgagaattttcttgtttttttgtgtacaattaaattattccattttatatatacttattaagttataagcatgttaataaggagacttttgactgtccagcctaatggaggatctgattcccattaaggatgtgggaattcccgtattttcctcttcaggtttttttgtttttaagtctacagagagatagaaccttaacattgcccagtttgataaaagtgaaaatttgctcacctatacaaatgttattttacacaattattttatgtggattggggttttaaaagattcatttcctagcagtttctgaatatttctgtaagatcttgataaagtttagagtcaaatggcagatattttggaaagccatttagtatgaggggaagagtacacattttaaatctttggtataatctaaacgatgtcatttcagacattcaaaactcataataataaatttcaggaaatcaagctcctaaacattaatagccaagataccaaataaattatcatattaaaatatttaagtttatttaaagagagaagtaaacataaacttatgtcaaagagaaattctcttaatctatttcctgacttcacagtcaaaacagtataagatagtgaagtaacttataatcttatttggtcattctgttctataaacagacaaatataatttaggctgctatatgacatgataaattaaaaactgagaaagtaaaattatgtcggggtctacacattaaatgactgttttggcagtttttcacctgaatttaaaaataaaatttgtctgttctatctgtatggacagaatatgacaaccatagaccaaaagatatcattgtatagatgtaaagagacaaaagtcatggttggcatgttctttaatttagggccttgtttatacttgtgagtttaataatttcttggcaatgagcactgctgcctttttaaatcatcaatgcctgtctttaaatgccaatcattagaagtttagaattacatttaaatttctcatatatgaatttttcatctgggaactacccactgtcgtcatttttatgtgcagaaaagatcctttttgaaaaccatatttattgggatcttatttaaatttaaattatcctttacaacttcttaaaatgaatatgctaatagataagactttatccattacatctaagaactttttaacctgtatatcaatctaaataggtttctagaaataatcctagctttcatacaccatgtagttctagactccgtccatatcagtgtaacattgtgtgataaaatgccaaatgtcttgtatctaagctacgctcccactcttccagccacccctacctcccaccttgacacccttaagaaagcaatgctgacttttattctgacaagtggaaatcaatagtggttaatcaagtggattttgtaaatgctaagaagtgtttgtgaaaaccttccctttctgagttaggattgttttttcctgttcatttcaggtgttttattgagcatctgatttgtgtcagcaccatgtaaatatgatgaggagtatttggaatagactttacattcaccagaaaattgatagtatttgttaaaccaatgcatccattcaaaatagaggcagagtaaacagcctaagaaatgatttcctttctacagtctgctaggagaaagaggtgagaggggagtggttgatgattttaatcaagagtaaagggaacatttattacatgaaatctgacttcagttgtgcaaaggtatgttaagacattaagacaattgctggaaggtttcaaatatgtgtacacacacatagagctacttttgtgtgtttatttatatgtatatttcacaaaggctaatgcccacagaggaaaatgattattttaacttctgggttatcatctgctggcagggtctgatcaggtctagagtatttaaggaaaagtctcctgtcttctatctccactagaagtactgcagcttgagagctgaaaggaacttgaaaaatgttatccagtcttcacttagcccatttttatcggcattaggaaatagggttcagcaatggttattgatttagcagtctggtcttatatgatctgctttctaattatctatctagtattcctatattatactggaacttcaataaattataacctatgtgaatatcataaattcttgtgaatttttgtctatttccagtagagaagcatactcagccaatgttttcacttaataactatgacaaccttaaaggatgtcacttaagttagaaaataagcaggcttaagaagtgattctaattaggacccccactcagtttgctagtcatgcctgcctgacagaacataagcttttgtaaagtatttagactgataacacatgcagtatgaaaacattatagactgcagttagaagactaattttttaaaagcactcaaaacatagaactaagatttagaatatatgtccatttataatgaaataatttgtgttcataatgtgaacatgtaagataagtaaataaagcattacttgttttataatatcaggaagagagaaggaaacattagtttataacaatgtgctatttaatatctgtattttgaacatttaaaatactctgatggtaaggttgccaaagtaattttgaattcataaaaattgtttataccacaataatgtgggatatgtttacaggctcttttattttgtggtagttactttatagttcagatgaatttgcatttcagtcacttatagtaaataaagtatattaaatatttgttggaataaaaatctcaatgtaataggacatagataaattatgcaacagcctgctttgatgaaagctggtgcattatgtgagctgccacagttaatactttgtattaacattgcttacttcccccatttgcttcacctatctgactacaattgctggaatcattctttttgtggtgcttcctccaagtgaaataactatgttattaaaacctactggattaattttatcaaatatcagacttactgatctcttggcagagatttattggtgtctcagtgtgatcacaatacaagttgtagcaaccattttataaaactcttagagaattatgtagataaaatggaaattacataatcctaaaacatttttgagggctaattgataataatttcagcaattttattaagaacccagtaaattaatccctaatttgtatgttttttgttcaacttaccgtgtctgcaaccattatatagacttcattgatactcagcaattactacagtgtgtcttacaatgttataaaaaacaaacagcaatctctgtttctgccagaagttagatatttttttatagtcctgatgaatttgttgtgagtagacaccacatagttatttctgtttgcatataaatttgctgctatttatttgtatgtttttctactgtagtatgctattgatttctgaagttataatcataatttttattttagtaatccaagctaaatgggcaaccagaagtaatatctgctagggtgcaatccatcagcattggttcagtgcatatacataagtaaaccagtttaaaaaaattttactaagcaaaaggtagtagcaatattgctagttaaagattaccattttaggggaaagttcaaaggtttaacttcctgaaaccttttaaacttttcagtgcaagaatgaaaatgtttgaaagccttgttaagctcataaaagtttcatttaaacactgtagagtttcctacctttgttgtgtaaaggatatagaaaatatttttctatggacagaaggttgaaactgttaacttctttaatttcattgtttaaaggagataaaatgttatttgtgtgtctttcatgctgtaaagaaaatgaatgtatctttcaaatgtcattagaattatggcttgattctaaggatactctatttgttttaaagtctacacgggattgaaaagaaagggaagagtattacacttcattgtacaaaatgtaattttagaagaaaaacattttcattataaacaagagcaatcattgaagcattttcagatataatgtacattctttttcattttgctttgcctctagaatagaaacttttcagaaaatttgcacatactgtttgtaagtataaaataattgaattctagacttttggagtgtggaagggtgtttgtgtgtgaaggtaataaatgtgttgctgcatgtgtttaccatagagaacgttgccaggctttgtcaaatgaggacattgttgtgagggtgtgacttttgtgaagccagaaaactgtgcctaagattcattacagtgagtatgtgcagaggcccctgacccagtaaatgctttttgcctttttattcccaatgtcttggacagttgagacaacttggcccaactctgaattgtagcagtgatgtcttatatgcttacgagtttatattaattcagctgaacaagaactacatcttaaaccacctttgtaggtatgattaatacgtgcaacagctgctttaaaaggtggtatttattattcatcactcatgaaacttgactcagtgaggacttcattatttttatttctctttccacgtctccaactttttaaaaatcactaatttaactctttgttaagtactcaagtacaaagtgatctcttctttcatgaactttgctataactgttgaaaggattggtgtcaggctctctcaaccctgggagtttccaaaatttagcaaatattacttgtgataagcttaaatgccacatcgctaagtacaattattaccaggaatccgtcaagggggagatagccccgctcacacccttagacccaaacaggtgctggttcatgctttctccacaaattggcagttgggtacttccccactgtcatcacagttgagctcattttaacatatattcaaagaagctttttagtttctactcctgaattgtagtgttcaagttatttgccttcctgggtaagaaaattttaacccaagtctgggattctctggcacctgtcttttcccatcttttaatgagttggcaagattaggtcaaatttcaatgctaaatttgattttttgaattttaaatagttgcactttatttcatgctgaccaccaacttaatttatacattttaaaataaaattatcctagaagtgttgtaaacgtgggaaaattttaattagtgttggaggtcattagattggacccaggtttaaatataatgatctcttcacagcttatttgatgtttaagagcaacttgtgtgatcttagctttgcaggttttctgtaatttatgtagcacaataaaggataaccagttgactgtgttactgga

SEQ ID NO: 5260 - DNA, 568 bp, Homo sapiens
ctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagagtcttgctgtgtcgtctgggttggagtgcagtggcacaatctcagctcattgcaacttctgcctcctgggttcaagcgattctcctgcctcagcctcccgagtagctgggactacagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggct

SEQ ID NO: 5261 - DNA, 662 bp, Homo sapiens
ctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagaaactacttttattaattctaggaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttc

SEQ ID NO: 5262 - DNA, 1964 bp, Homo sapiens
gtccagccatgtttagtccattaacagcaataaagtgttctgacgcttcagactagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaaaaatgaagaactcaaaaaaactttgaaaacttcagcactgttgcactttatgttttaaaaaatgtcactctttcaaaatctataactcatgtatttgaa

SEQ ID NO: 5263 - DNA, 3708 bp, Homo sapiens
atgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaaggttataaggcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaaaaaaaagaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgatggcgtcttttcagtctactctacctaa

SEQ ID NO: 5264 - DNA, 3903 bp, Homo sapiens
gagaacagatgggcaggtccacagcactgccagattctgcacaagctccatttatcgttggttcttgcttttttccttctgtgtttttaattttttaaaaaacattgtatgttctagagaactagcttcacaaaaggtcggtggctgatgatctttcagctaagatttcaaatgtagaagaacaattcaaaatgctatcactgtgtatgtaagaaggatggggcagatttcattttaccctctagtctccctcaatgcatgcacggatttatctgtacgctaagctctctgctctgcatctgtagctccttgtggattatattgtctcagtgatcagaaatgattttctcggatatgaacaccgtttctggctcccctaaagtgcatcctcctaatgggacccggttttacacttttcaagaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactaaagaatctgaggaaggaagctgggcccagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcagcactgacctgctatggcgtcttttcagtctactctacctaaagtgcactaccatctaagaagacgagcagtg

SEQ ID NO: 5265 - DNA, 2834 bp, Homo sapiens
aatgctgttcagctgcctgtttgaagaaagtttattttttaaaaactatgtttgcagttggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagttggcagctaccagaccagcaagagttatgagagctggttaccaattccagagcataaattaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccagccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaacttgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcagcactgacctgctatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatgg

SEQ ID NO: 5266 - DNA, 3783 bp, Homo sapiens
agaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaatgcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgatggcgtcttttcagtctactctacctaa

SEQ ID NO: 5267 - DNA, 574 bp, Homo sapiens
aagatgctgtagcgtcctcaccggctgccagcaggttggttcttccggccaattgaagcaagcaaagaggcttgcagaaaggccgggaggagaaaaatggggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaag

SEQ ID NO: 5268 - DNA, 5363 bp, Homo sapiens
gaggcaagtgaggagagaagatgctgtagcgtcctcaccggctgccagcagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcagcactgacctgctatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggaccaagaaaaaaaaaaagataaaaaaacttctttactaagaaccacatgttcattcaaatatcttgaaatgccagccagtactggacagtgaatgtcaaccaccgcagagtctgaggctcatttccactagagaaaacgaaacccaagatacctttcccttttgtcaatgtaacagggcattagccagactcatgtctaatgttataagcttttagccgagatggccttgttgcgacttccctgaagtcagttttatcagaggaaataaatgaaagacagaatgattaacatatatagtgtataaaagtatagaagagtaatctcttccctgtggctttatttggtggtgttactgttgtttattctttgtttatatgggagattcaaagtaaagcctatttaataataccatttatctaactgctgattttctgctgcttgatcttattaagcgcaagacctgtcattagtaatttcttttctgtattttaatttgctatgtttgcacgtacattacatttgttttgatgtctatttttatttaacagattcagtcaaaaggtaatgataacagaaaccctttccattgtcaataaaaaaaataataattcca

SEQ ID NO: 5269 - DNA, 3529 bp, Homo sapiens
accaccccagcgatggagcctactctgctccaagccgccgctaagacccggagaagcggaatttcactttgaaattcccttgcctcgtgagggccggcgctgggcatgctcagtagccgcggcgctgctgctgggctgctgggctggcgcggagtccaccctgccgtctccgccttggcttctgggcgtccagaaggccaggcatttgccgcctctgagcgcttctgttccccttacccgcaacctcctactgctcttcctctctccctctcttagggaggttgaagctggtgctggtttctgtcggcgccacagactgactgctctgcaaaccccagccgaggacctgaatcccggagactagaagacccttggcggtggctctttctaatagcactttacctgaagtggggtcgtggtggagtttctcctccacctctcaatgcaaacactatgcggagagcagtctgcttccctgcgctgtgcctgctccttaatcttcacgctgcagggtgcttttcaggaaacaatgatcattttttggcaattaatcagaagaagagtgggaagccggtattcatttataagcattcacaagacattgagaagagcctggatatagccccacaaaaaatctacagacatagctaccattcctcttccgaagctcaagtaagcaaacgccaccagattgtcaattcagcatttcctagacccgcatatgacccgtctctcaatctgctggccatggatggtcaagatcttgaagtggaaaatctcccaatcccagcagcaaatgtaattgtggtgacactgcaaatggatgtaaacaagctgaacataaccttgcttcggatcttccgccaaggagtggctgcagctttaggactcttaccccagcaagtgcacatcaatcgcctcattggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatact

SEQ ID NO: 5270 - DNA, 2458 bp, Homo sapiens
atgaaccagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatact

SEQ ID NO: 5271 - DNA, 2818 bp, Homo sapiens
acttaaaacagagtaaggaaatcagaaacaatttcctccacacagaaaagaacagaactctcttacctatgaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtaggtgtgttgcactacactgaatggaataaggctaaaaatatgtttagtgtctgataagaacgccagttttctcaagctctcatttaacgtcggactttctgttttgcttttaaagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatactaaatactga

SEQ ID NO: 5272 - DNA, 1603 bp, Homo sapiens
aaaagtaaagaggtagtacagcacgtaatccagggtgctgatgttgtgggaggggacttaaaacagagtaaggaaatcagaaacaatttcctccacacagaaaagaacagaactctcttacctatgaaccagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcat

SEQ ID NO: 5273 - DNA, 1024 bp, Homo sapiens
acttgtttcacttttgtttaaaagtaaagaggtagtacagcacgtaatccagggtgctgatgttgtgggaggggacttaaaacagagtaaggaaatcagaaacaatttcctccacacagaaaagaacagaactctcttacctatgaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgag

SEQ ID NO: 5274 - DNA, 12480 bp, Homo sapiens
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 5275 - DNA, 12483 bp, Homo sapiens
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcaggcacccagcggaacacactgtgggaaatgccactctaggccgtgcggcgtcccccggaatggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 5276 - DNA, 12453 bp, Homo sapiens
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 5277 - DNA, 12559 bp, Homo sapiens
ccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcaatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 5278 - DNA, 12646 bp, Homo sapiens
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 5279 - DNA, 12755 bp, Homo sapiens
ttaggactcgggggacaccgccccccgccccccgcgtcccgcccccgcccagcctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 5280 - DNA, 12660 bp, Homo sapiens
gttaggactcgggggacaccgccccccgccccccgcgtcccgcccccgcccagcctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 5281 - DNA, 4257 bp, Homo sapiens
ctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtggcagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccattctcagaacacctctgagtaacgtgtttgccagtagctattctcactgatgcactgatggccctgaagaagcggatccagtcacataggaaaggaggctgtgttagtgaaagcacatggaaggtgttgctttagaaaggtagtcaggaaaaacattcaggaatagatttatacaccattattgttttatttttaaattttcattcactcttctgtttggatacttttgctaattaacttcctatgttaatttccaccaagctataagtccatagtcagtaaaacattccccttgggctgtcatgagctaaaagcagtgtcatctccgcatgttggagcagccaagaaatagtttggtactaccgacattgtctaatccatgtcacatcctcatacaatttaattgctcaaccatgcatttaaaactcctcaagaaaggattggtactgcaactgtaggtaaactgaaaaaaaataagaaagaaagagttggatgaaaatgtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcagctcactgcaagctccacctcccgggttcacgccatcctcctgcctcagcctcctgagtagctgggactacaggtgcctgccaccacacccagctaattttttttgtatttttagtagagacggggtttcaccgtgttagccaggatggtcttgatctcctgacctcgtgatccacccgcctcagcctcccaaagtgctgggattgcaggcatgagccactgcacccaacccctggaaaactaaatttttaagtgcttatttttatagaagtttgaaaatttaatgcaggcaggtgtgtaataaattatttttgaattgaacattaaaattctgcttcttaaagtcagcactcaacttggacatgttgaaattagaatctattcttgtatttgatagacaaaatatgtgggaaagattttttgcatgacttttctctcattttattcttccataatgtatttctactataaaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtccgcagtagtgcttttgtcagcacagactgctaatctacatcttgctgcgttctgtttgctgaggttgggcttattcatttaacacataccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaa

SEQ ID NO: 5282 - DNA, 3210 bp, Homo sapiens
agcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattctaa

SEQ ID NO: 5283 - DNA, 4161 bp, Homo sapiens
ggtactccttcctggaccgcgctggaagccctggcggcggcggcccatggggcccttggcgctgcccgcctggctgcagcccaggtataggaagaatgcgtatcttttcatctattacttaatccagttctgtggccactcttggatatttacaaatatgacagtcagattcttttcatttggaaaagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgtcttttggaatctattggatatggttaggtacacttatagcatgttatcagtcataggaatatcctatgctgtcttgacatggctcagtcaaacactatggatgccaatttatcctttgtgtgttcttgctgaagcatttgccatctatcaatcgctgccttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtggaaaaataccttgtatttgataaaaatccattacatgaaataactgcacatacccccaaaactctagacataacaggctatgtttttcacacattgtatttttaagacatatatattctccataccctgcttcaccaaaattcctgcttcatttggattttatacaagttatacttacattgtatgaagtctgattattttcctgtaagtttaatgagaaataggagattagctgcaatagattcaattaaattaagaaaccaaacttgataacctaaattacatgtattctttttcacttccaagttcccaaatagatctgtaggagaagagggatggaaaatatattccacagttgcctagaataacatatttcatagacagatgtctgtcttcagatctaataatactcaccctaaacattagatatgtttagaaaattaaatatctttccaagccctatgtcttagctcaggttgctataatagaacaccataaaccgaatggcttaaacaacagcaaacgcttctcacagttctggaggctgggaattccgctcaggatcaaggcatcagctaatgcagtttctggtgagggccctcttcccagtttgcagatagatgtccttctttgtcctcacatgagagagagatcaactctcttatgtctcttataatggcactaaccccattcatgagggctctaccctcatgatctaattacctcccaatggccccacctccaaataccatcatattggaggttagggcttaacacatgaattttgggggaacacaaagattcactccatagcattctgtacctggtcctacaaaattcatgtcctcctcacatgcaaaatacatacattccatctcgacagcctcaaaagtcttaactcattcctgcatcaactctaaagtccaaagtctcgtctaaatcagatgtgggtgagattcaaggtagaattcatcctgaggtaaaattcctttccagctttgaacttgtgaaatgaaacaagttatgtgcttccacagtacaatggtgggacacacaaagggtggacattcctattcccaaagcaagaaacaggaaaaaaggaaggtgtaatgggtccccagcaagtccaaaacctagcaaggcaaacaccatgagatcttcagtcttagtaataatcctctttggcctgatactctggcttcaggacccagtgaggcagaggtattgcccccaggactatgttggaggaggatgacccccatatcaccaggcggaagctgtcaggcctgttgaaaccaaggcaatgactgccccttttgaaactgagaaggtaccactgatgttctctgaatcattgttccgggtcagtttctccttttcttgaagaatagtgtacattcacagctgaatagctctatggtcccaaattcaagaagtccaacagtcttccctcattctgtcccatctccattcctttcaatacaaactagcagtgttcctgctggggtggctgattaggtctgtggttcacacccacataaatctaattggatgacttgtctgctacactcttagtgttctctaccaaacgtgttttcttatctttttgtaatgcagacagactgataatttcccacatcttttaagttctggttccgtttttgttaagaattctgtcttcattttttgtcacattttactttaagcagtcaagataaaccgaggcactccttcaacactggttggagatctcttcagttcaatatctaatttcatggctcacaattttactttccacaaaacactagaacatgaacacaatcatccaagttctttggcatattataacaaagatcacctttcttccagtttcccataacaggttcctcattttcatttgagacttcatcagaatggcctttattgtccatgtctaccaacattatcttcatggtgatttacgtgttctctatgaagatggaggctttctctcccaccctcttctctttgagccctcaccaaaatcacctctatcaatcccttcatggcaatactggctttttctagcaaaaaaactagtacctcaaaactcttccagtactcttccaggtactctagtacctcaaaactcttccagcttctatctgttacctaacgtcaaagctgcttccacatctttatatattggttatagcatcaccacacttcttggtactaattgctgtcttagcttggctgctataacaaaataccataaactgggtggcttagacaacaaatatatttctcacagttctggaggcagggaagtccaagataaaggtgctagacaattaagttcctgatgaggttccaaggtgctagctgattcttcttcatggtttgcagatgaatgccttcttgctatatgttcacatggtggagggagaaaccatctctcccttatttcttattgtaaaggtactaatcccatttatgaaggttccagcttcaaatgccatcacactggagattagattttcaacatgtgaatttaatgggggacaccagcattcagtccctagtgctctgatagagtattcattaatgtcatgtatttgttaacatcttgtaagttatttgggctttgatgccttaaaagaagaccctggccaggcatgctggctcatacctgtaatcctagcactatgagaggctgaggtgggcagatcagttgaggtcaggagttcaagaccagcctggccaacatggtgaaaccccatttctactaaaaatacaaaaattagccaggcatggtggcgcatgcctgtaatcccagctacacgggaggctgggggcatgagaatcgcttgagcccaggagatggaggttgcagtgagcagagattgagccactgcactccagcctgggtgacagagtgagactctatctcaaaagagaagaccctaatgaaaatagtaaacctttagcaaatacacaaatgatgccccattctgtattctttttaattttaaaaataatgacacacacatacaggaagataaaaggtataaaaatatactaagtactttttaaaaaggaaaattcatgttttggattattactgaattgttgctaattactgtaatgtaagtcatatgtccttacatagttttgaaaaatgctttctttgaaaatctaaaaaaagtgtgaataactgatagtcattgctgtatcattgatgtatcactcaatttttggtaaagaattataaagatcttacctagaaactatgtaaaaaggtattaaatatattgtgatgtaagaataggataataaaaatgtaattttaaaaa

SEQ ID NO: 5284 - DNA, 2131 bp, Homo sapiens
gccctggcggcggcggcccatggggcccttggcgctgcccgcctggctgcagcccaggtataggaagaatgcgtatcttttcatctattacttaatccagttctgtggccactcttggatatttacaaatatgacagtcagattcttttcatttggaaaagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgtcttttggaatctattggatatggttaggtacacttatagcatgttatcagtcataggaatatcctatgctgtcttgacatggctcagtcaaacactatggatgccaatttatcctttgtgtgttcttgctgaagcatttgccatctatcaatcgctgccttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtggaaaaataccttgtatttgataaaaatccattacatgaaataactgcacatacccccaaaactctagacataacaggctatgtttttcacacattgtatttttaagacatatatattctccataccctgcttcaccaaaattcctgcttcatttggattttatacaagttatacttacattgtatgaagtctgattattttcctgtaagtttaatgagaaataggagattagctgcaatagattcaattaaattaagaaaccaaacttgataacctaaattacatgtattctttttcacttccaagttcccaaatagatctgtaggagaagagggatggaaaatatattccacagttgcctagaataacatatttcatagacagatgtctgtcttcagatctaataatactcaccctaaacattagatatgtttagaaaattaaatatctttccaagccctatgtcttagctcaggttgctataatagaacaccataaaccgaatggcttaaacaacagcaaacgcttctcacagttctggaggctgggaattccgctcaggatcaaggcatcagctaatgcagtttctggacccagtgaggcagaggtattgcccccaggactatgttggaggaggatgacccccatatcaccaggcggaagctgtcaggcctgttgaaaccaaggcaatgactgccccttttgaaactgagaagcagggagaagataatatcttcaagctttcacaaagaaaatctccacattgaactcaagccaaataaagaaaatccaagttcctgtttcagtctcaactggcccgggtactaaagcaatgcactcctctcttaggaggcatgtgtcaagctgtcagtgatgtggccatcttttcatgacccttaactctctgcatcatgtctcagcaataccaggcatgaattctgaaaaacttcttccacttatatggttttcctcatccagctgagaatgctgctggttactgcaaaactgttcaccaaccatatgctctggtccatacagctttcttcttaaactctgggagaactctcaaggacagcagggtggctaaggggacaaaatataggtatggctgcatttgaaaaggtcattttgatcaaaaaggtgtcagaacagaatttgtctttttctcacttggctaatgttcaagactagggagttccatcgatattttggcaggattttaatggcagaaaaccatttataaatgttggggggaaagttgtttttttttttttttttaagttaccctgcaatcagttaatgggaaattctgcagaattaaaatgaaagctg

SEQ ID NO: 5285 - DNA, 2498 bp, Homo sapiens
tgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataa

SEQ ID NO: 5286 - DNA, 4163 bp, Homo sapiens
actctttggagtctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccgaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatc

SEQ ID NO: 5287 - DNA, 5251 bp, Homo sapiens
atggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 5288 - DNA, 3274 bp, Homo sapiens
actaataaaggaagacacggacagatgaacttaaaagagaagctttagctgccaaagattgggaaagggaaaggacaaaaaagacccctgggctacacggcgtaggtgcagggtttcctactgctgttcttttatgctgggagctgtggctgtaaccaactaggaaataacgtatgcagcagctatggctgtcagagagttgtgcttcccaagacaaaggcaagtcctgtttctttttcttttttggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcacgcgccagtatttcaggacaaagaaacagtcttaaaaatatcagaaaatacagctgaagggacagcatttagactagaaagagcacaggatccagatggaggacttaacggtatccaaaactacacgatcagccccaactcttttttccatattaacattagtggcggtgatgaaggcatgatatatccagagctagtgttggacaaagcactggatcgggaggagcagggagagctcagcttaaccctcacagcgctggatggtgggtctccatccaggtctgggacctctactgtacgcatcgttgtcttggacgtcaatgacaatgccccacagtttgcccaggctctgtatgagacccaggctccagaaaacagccccattgggttccttattgttaaggtatgggcagaagatgtagactctggagtcaacgcggaagtatcctattcattttttgatgcctcagaaaatattcgaacaacctttcaaatcaatcctttttctggggaaatctttctcagagaattgcttgattatgagttagtaaattcttacaaaataaatatacaggcaatggacggtggaggcctttctgcaagatgtagggttttagtggaagtattggacaccaatgacaatccccctgaactgatcgtatcatcattttccaactctgttgctgagaattctcctgagacgccgctggctgtttttaagattaatgacagagactctggagaaaatggaaagatggtttgctacattcaagagaatctgccattcctactaaaaccttctgtggagaatttttacatcctaattacagaaggcgcgctggacagagagatcagagccgagtacaacatcactatcaccgtcactgacttggggacacccaggctgaaaaccgagcacaacataacggtcctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagagaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctcgtggtgcttgtcaaggacaatggcgagcctcctcgctcggccaccgccacgctgcacttgctcctggtggacggcttctcccagccctacctgcctctcccggaggcggccccggcccaggcccaggccgaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgaggggcgctgagaccctgtcccagagctaccagtatgaggtgtgtctgacgggaggccccgggaccagtgagttcaagttcttgaaaccagttatttcggatattcaggcacagggccctgggaggaagggtgaagaaaattccaccttccgaaatagctttggatttaatattcagtaaagtctgtttttagtttcatatacttttggtgtgttacatagccatgtttctattagtttacttttaaatctcaaatttaagttattatgcaacttcaagcattattttcaagtagtatacccctgtggttttacaatgtttcatcatttttttgcattaataacaactgggtttaatttaatgagtatttttttctaaatgatagtgttaaggttttaattctttccaactgcccaaggaattaattactattatatctcattacagaaatctgaggttttgattcatttcagagcttgcatctcatgattctaatcacttctgtctatagtgtacttgctctatttaagaaggcatatctacatttccaaactcattctaacattctatatattcgtgtttgaaaaccatgtcatttatttctacatcatgtatttaaaaagaaatatttctctactactatgctcatgacaaaatgaaacaaagcatattgtgagcaatactgaacatcaataatacccttagtttatatacttattattttatctttaagcatgctacttttacttggccaatattttcttatgttaacttttgctgatgtataaaacagactatgccttataattgaaataaaattataatctgcctgaaaatgaataaaaataaaacattttgaaatgtgtg

SEQ ID NO: 5289 - DNA, 3063 bp, Homo sapiens
atgatggagacgccgctccccaaagcaccagagaaaaggcaagtgaccgccattattttcttattactactgtgggaggcgggcagcgctacgattaagtattcagttctagaagagagggacagcggctcttttgtggccaacttagcaaaagatctggggctgggtgtaggggaactggccgcgagaggcgcccggattctttccaaagggaacaaacagtatttgcagctcgaacggaagagtgggaatttgctcctaaaagaaaaattggaccgggaagagttgtgcggtgacatagatccatgtatactacatttccagatgttactgaaaaatccggtgcagtttattcaaggtgaactacagctccaagatgtaaatgaccatgccccagaattcttggaaaatgaaatcctcctgaaaatctccgaaggcagccatccagggacttcatttcctttgaaaatagctcaagatttggacgtaggtagcaacacagttcagaactactcaattagcaccaactcctatttccaccttttcactcgcaatcacagcgacggcaagaaatacccagagctcgtgctggatcaagcgctggaccgcgaggagcagccccagctcaggttaaccctcacagcgctggatggtgggtcaccgcccagaactgggacttcccaggttctcatagtgattgtagatatcaatgacaacgtccctgaatttgctcagcggcgctacgaggtgcaggtcccagagaacacccctataggttcccttgtcatcaccgtctctgccagggatttagatgctgggacccacggggagctctcctattcattttttcaatactccaatcaaatcattcaggcctttgaaataaactcaatcacgggagaaattagatttaaaaaggcgttggattttgaggaaattcaatcttatcacatggaagttgaggcctcagacggtgggggtctttcaggaaaatgcaccgtagccatagaggtaatggatataaacgacaacgcaccggaacttactatgtccttacttatcagtgatatcctagaaaactccccagaaacagtggtcgctgttttcggaatttcggatccggactccgggaacaatggaaaaatgatgtgttccatccaagaccatctccctttccttctaaaacctaccttagaaaatttctacactttgttaacagaaggagcgctagacagagagagcagggccgagtacaacatcaccattactgtcacagacttggggacacccaggctgaaaaccgagtacaacataaccctgcgggtctccgacgtcaatgacaacgcccccgccttcacccaaacctcctacaccctgttcgtccgcgagaacaacagccccgccctgcacatcggcagtgtcagcgccacagacagagactcaggcaccaacgctcaggtcacctactcgctgctgccgccccagaacccgcacctgcccctcgcctccctggtctccatcaacacagacaacggccacctgtttgccctcaggtcgctggactacgaggccctgcaggagttcgagttccgcgtgggcgcctcagaccgcggttctccggctttgagcagcgaggcgctggtgcgcgtgctggtgtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctccctgaggcggccccggcccaggcccaggccgactcgctcaccgtctacctggtggtggcgttggcttcggtgtcttcgctcttcctcttctcggtgctcctgttcgtggcggtgcggctgtgcagaaggagcagggcggcctcggtgggtcgctactcggtgcccgagggcccctttccagggcatctggtggacgtgagtggcaccaggaccctgtcccagaattatcagtatgaagtttacctggcagaaagctctgagagccagttaaagtttcttaaaccggtacttcccaacttcttgggtgaagggactggtggggacagcgaggcaaactccaactctaggaatcattttgggttcaattaggaatctgacaacaggtcgtgataaatcatagaattcactattcatctgtaagttcccaattctctcattcgcgtagagtcacatattcacacattagtaatggctgtcatatttatagctatttcaacctgctggactattttccattccctttaatttttgttgtggtggttgtcagctatgttagttacagcatgtgcacacaatagcagagaaatggtgtttcctatggttgttgtttttgtttggtcagattttggaactcacaggtgttttcaggttcccagtatttgaacttgttcattgatatgttatgattaagagaatagtgtttcaaactttctggttatcatcagcatgactctaagtctatcgtaaatcacagcttttagcctaaaaaataattttcatttatgcaaaaattttagtaatcttgtaaattgttgcacttctgttgtgttgtttcaaaaacactactcttccctcaaatgaaccaatattttacctaggtgatgttttctctcctgaatttcttttttcaaaattgatatttatagaccatcggctgttattctaaaggattcaactcctgttacatgaaagaataatagaaaaaaggttggttgacttgtgattgctttttttttaataataaatggctttggtatgt

SEQ ID NO: 5290 - DNA, 2361 bp, Homo sapiens
ggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagcgaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 5291 - DNA, 2997 bp, Homo sapiens
ggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 5292 - DNA, 2796 bp, Homo sapiens
ggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagagaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 5293 - DNA, 2214 bp, Homo sapiens
tcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctg

SEQ ID NO: 5294 - DNA, 2238 bp, Homo sapiens
ctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaaggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 5295 - DNA, 2788 bp, Homo sapiens
cgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 5296 - DNA, 1850 bp, Homo sapiens
gaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttcc

SEQ ID NO: 5297 - DNA, 845 bp, Homo sapiens
ccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaaggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacag

SEQ ID NO: 5298 - DNA, 825 bp, Homo sapiens
ggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcagaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctcc

SEQ ID NO: 5299 - DNA, 11547 bp, Homo sapiens
tgcagtaaacattgctatcttcagaaattaaggaatgagaggcaaggaagaaaggacattcatcttggaaagacccaaagcaccttgaaatttggaaggaatgttttgctagctgctaaaaccacctttgtcaccagaatgaatgaagtgcttcagatttaaataattgatcattcttagaagagctgctgtaacacataggggaagtgaaaactaacagatgaaagttttgtcatgcactgaaagaaaagcattgtctgtgaagttctatttttaaaaatgtctgcttgtaacacctttactgaacatgtttggaaacctggtgaatgcaagaattgctttaaacctaaaagtttgcaccagcttcccccagaccctgagaaggcacccatcacccatggcaatgtgaaaactaatgccaatcacagtaacaaccaccgcatcaggaacacgggcaatttccggcctcctgtggctaaaaaacccactatagctgtgaagcccactatgatagtggcagatgggcaaagtatatgtggtgagcttagcatccaagaacactgtgagaacaaacctgtcatcatagggtggaaccgaaacagagctgccttgagtcagaaaccacttaacaataataatgaagatgatgaaggaattagccatgttcctaagccttatggcaataatgatagtgcaaagaagatgtcagataacaataatggactaactgaagtgttaaaggagatagcaggcttggatactgcccctcagataagaggaaatgaaacaaactccagagaaacattcttgggaagaataaatgattgctataaacgatcattggaaagaaagcttccaccaagttgcatgataggtgggataaaggaaactcagggcaagcatgttattctgagtgggagcacagaagtgattagtaatgaagggggccggttctgttacccagagttttccagtggcgaggagagtgaagaggatgtacttttcagtaacatggaggaggagcacgagagttgggatgagagtgatgaagagctgttggccatggagattcgcatgagagggcaacctcgctttgccaacttcagagcaaacacattgtctcctgttcgattctttgtggacaaaaaatggaataccatccccctgcgaaacaagtctctgcagagaatctgtgctgtggactatgatgacagctatgatgaaatcctgaatggttatgaggaaaattctgtggtctcttatggacaaggaagcattcagagcatggtgtcatctgactccacatcaccagattcttctttaacagaagaatcacgttctgagacagccagtagtttatcccagaagatttgtaatgggggattatctcctggtaacccaggagattctaaggacatgaaggaaattgagcccaattatgaaagtccctctagtaataatcaggataaagattcatcacaggcttccaaaagctcaataaaagttccagagacccacaaagcagtccttgctctccgattagaagagaaagatggcaagattgctgtacaaactgagaaggaagaaagtaaagcctctacagatgttgctgggcaagcagtaaccataaaccttgtccccacagaagagcaagcaaaaccttaccgagttgtgaacctggaacagccattgtgcaagccatatactgtcgtggatgtgtcagcagccatggccagtgagcacctcgagggccctgttaacagccccaagacaaaaagctcatcctctactccaaactctccagttacatcatcttcattgacaccaggacaaataagtgcccatttccaaaaatccagtgcaattcgataccaagaagtatggacttctagcaccagtccacgacaaaagatacctaaagtagaactaattactagtggaactggaccaaatgttcctccaaggaaaaactgtcacaaatcagcacctacatcacccacagctacaaacatttcctccaaaaccatccctgttaagtcacctaatttgtctgaaattaaatttaatagttataacaatgctggtatgccaccttttccaattatcattcatgacgagccaacttatgctcggagttccaaaaatgctatcaaagttcccattgttatcaatccaaatgcatatgacaatctagctatctacaaaagttttctgggaacaagtggagaactctcagtgaaggaaaaaaccacaagtgtaataagccatacttatgaagaaatagaaacagaaagcaaagtgcctgataacaccactagcaaaaccactgactgtcttcaaactaaagggttttcaaacagcacagagcataaaaggggctcagtggctcagaaggttcaagagtttaacaactgtctcaacagaggtcagtcttcaccacagagaagctatagttccagccacagctccccagcaaagatccagagagccactcaagagcctgtggccaaaatagaaggcactcaggagtctcagatggtgggcagcagcagcaccagagagaaagcaagcacagtgctttctcagattgtggcttcaatccaacccccacagtctcctccagaaacacctcaatctggccctaaagcttgcagtgtggaagagctttatgccattcctccagatgctgatgttgctaagagcacacctaagagtacgccagtccggcccaaatctctctttacatctcagcctagtggtgaggctgaagcacctcagaccacagacagtcctaccaccaaagtacagaaagacccatccataaagccagtcaccccctctccctccaaattagtgactagcccccaaagtgagccaccagctccctttcccccgccacgctctacttcttctccttaccatgcaggtaaccttttgcagaggcatttcaccaactggaccaagccaaccagccctaccaggtcaacagaagctgaatcagttttgcactctgaaggcagcaggcgggcagctgatgcaaaacctaagcgctggatatcatttaaaagcttcttccgccgtcggaaaacagatgaggaggatgacaaagagaaagagcgagagaaagggaaactggtgggcctggatggcacagtcattcacatgctgcctcctcctccagttcagcgccatcactggttcacagaggcgaaaggagagtccagtgagaaaccagccattgtcttcatgtacaggtgcgaccctgctcaaggccagctcagtgtggatcagagcaaggctaggacagaccaggcagcagtcatggagaagggtagagcagagaatgcattactacaggactcagagaagaagaggagtcattcttctccatcacagattcctaaaaagattctcagtcacatgacccatgaagtaacagaggatttttctcctcgggatccaagaactgttgttgggaagcaagatggcaggggctgcacttcagtcacaacagcattgtccctacctgaactggaaagggaagatggaaaagaagacatttcagatcctatggacccgaacccttgtagtgcaacatacagcaacttagggcaatctagagcagccatgatacctcccaagcagccacgacagcccaagggagctgtggacgatgccatcgcctttggagggaaaacagaccaagaagcacccaatgcttcccaacctacaccacccccactgccaaagaagatgatcataagagccaatacagagccaatctccaaggacctccaaaaatccatggaaagtagtctttgtgtcatggctaatcccacctatgatatcgaccccaactgggatgccagcagtgctggttcttccatcagctatgaactcaaaggactggacattgagtcttatgactccttggaaaggcctttgcgcaaggagagacctgtcccctcagcagcaaacagcatttccagcttaaccactctcagtattaaggatagattttccaacagcatggaatccctctccagccggcgtgggccctcttgcagacagggccgaggcatccagaagccgcagagacaagcactttatcgaggacttgagaatcgggaggaagtagtgggtaaaatccgaagccttcatacagatgccttgaagaaactggctgttaaatgcgaagaccttttcatggctgggcagaaagaccagctccgttttggagtggacagctggtcagacttcaggctaaccagtgacaaaccatgttgtgaggcaggtgatgcggtttactatactgcttcatatgcaaaagatccacttaataactatgcagtcaagatctgtaagagcaaagctaaagaatctcagcagtattatcacagcttggctgtccggcagagtctggctgtccattttaacattcagcaggactgtggtcatttccttgctgaagtccctaaccgtctgcttccctgggaggatccagatgaccctgaaaaggatgaggatgacatggaagagactgaagaagacgccaaaggagaaacggatgggaaaaacccaaagccctgttctgaagcagcatcatcccagaaagagaatcagggagtcatgagcaagaagcagaggagccacgttgtggtcatcaccagggaggttccatgtcttactgtggctgattttgtgcgagactctctggcccagcatgggaaaagccctgatttgtatgagaggcaggtgtgtctgctgctcttacagctatgctctggtcttgagcacctcaaaccctaccatgtcactcactgcgatctacgcctagagaacctgctacttgtccactaccagcctggggggactgcccaaggctttgggcctgcagagcccagccccacctcatcttatcccactaggcttatagtgagcaacttctctcaggccaagcagaagagccatctggtggaccccgagatcctccgggaccagtctcgccttgccccagagatcataacagctacccagtataaaaagtgtgatgagttccagacaggcatcctcatctatgagatgctgcacctacccaacccctttgatgagaacccagagctgaaggagagggaatacacacgagcagacctgcctcgcatcccattccgctccccctactcccggggtctgcagcagctggccagctgcctcctgaatcccaacccttctgagcggatcctcatttcagacgccaaaggcatcctccagtgtctgctctggggcccccgcgaagatctcttccagactttcaccgcctgccctagcctagtacagaggaacaccctgctccaaaactggctagacatcaagcgaacactgctcatgatcaagtttgctgagaagtccctggacagggaaggtggaatcagccttgaggactggctttgtgctcagtatttggcttttgccactacagactccctcagttgtattgtgaaaattctgcagcaccgttaatgtgtacctggatgatgcttttactacatcttcaccttcttcatgtcacccatgcacttcccctccctagtgctcactccaaattcaaggaaagaagaaaggcaaacctctatccctgtccgtgaacaagtgggtctattcagaaaggttatccactgccccagattgaatgagaagctgagtctgtcttaactttacagaaattcagctgcacaaacttgcagttgccttcccttgaaacaccttctatcctaatagtcccataaatgcaggtaaaaatgaaaatccatattcttgaagggacagcttctttggtatgaactcagccagtgagctgtgtccatttcctccataattctggatatcacctatctttttagcaccaagtatttattctcactagcagtagacagacttaaccagtctctaccacgacccagtagactctgacaacagactcttcctttaaggtgtcaacaactgacttactaggcaggactgccatccttagcatcagcccagttttggttaccagggactatatcttttgttccaggagagagtagaaagaaaaggagagatcccatccttgggtcatagacccattttcattgccattatctgtaagtatgtgcactgcatggaggacagccctaatagtctcccctctgctgccactgcctgattctccactctgtccccacttgccagtgaagtttggatttatcagccacttgtggcccattacagagctgacccaaggtggtgtcaccaatgcctcagcagggtggagtgcagttcagagcttataaatagctggcagggcatgaggagatgattttcttgcatgtgcaattctctaggggccatcaggaaacagagtttaaagtaccctttgattactgtcagaactgtcagcatttgcagttttccccgagcagtaattggccagctcccttctatcagtagccagtgttaactagtttaccaaatgctgtaaacaattgccctgaatgaaatagctgtcagtggagctctaagatctcctttagagggcacagtgaggtgggctgttgggatggccgtaggcaggggagaggaagaaggccactgatgagactgctgacctcctcagaaggttgacctcttctagagagactgcctcccagtgtttaagtggctcattgctccttctgactctgtaaaatggctctggaggacagctcacaggaattctgattgctgaggtgggtgattgagagctgttcaccatgtgtgcagcctgtgctccccttctatggatatgtgtgcaatttttgtatgtatttttttagctgtatattacagtgtttatgttgcaacttcacctgaagcgagtctacagaaaccctcccccttcttcccttggcacatatttgcgctaagagatgagcgttccttccactggggttgtgtgtgtgtgtgtgtgtgtgtgtgtgtgtgtgtgtgtgtgtgtatgtatacacatgttcacctgtgcttgttttattcaaaactgtgagtatgtgtttactttgaccttgaaatcccaagagtcactcgaacaatgtgtgtgtacacttgtgtgcccatgtgtgcgtgcacacgcatgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatctttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagccagagaaaagcctcaggcttcccagagacaggtggctagattaatttttctctgggtgatggccaaagaatgtgagatagagagggaagggggtgttacaggttagagcagaatagagaaagaaactatatttctaggcaaaaagtactacatgagttggtcttcagaatatttttccaaaaaaatgaaattcagtcagtttaacattatcacaaatatttttcattttaattgtggtaggacctttgaatttgttcatcaactggaaagaaatcctaccctctgtagacacatacacacacatttatatatctatgtgtttgaattgtgactagtatagcactttacattttctcaagtaacaggaagttattgccttcaatattgattggaaattgttttctattgaagtctatactgtagagttttccatttatattgagagtttgaacaattaagctcctattggaacttttccttaagccacatgagcatgaacaatctctgtgacacttgggtgctagagaaacacaacagtggctaaagtagccaagagcaagactgaatgtatagcagagtgccttgttagagtggtaacctagtcttggaagcaattcagtggatgtttcataaagaggactagaacttcaagaagcctcctgtgctggctgaggtgagcccttttggtatatgtacactactgggttgcctagaagccaattcatgaagaataacagcaggatgagaaaaagagtcactgtaacctgtggaacaacaacgtaagaatcaccaacccctaggctgagctagaactggaagccaggaatatggcaatgagtttcaagatttgccctcagaagatgaactgggtgaggtatgggttgaggtgagggcacaagcactcatcctacctaccctgctgctgttgaggagctagaagtaaaacatattggttaggattttaacagttggagtagcctcccattatcagattaagtgggggtcacttttgcttccaaactcagaataagtttgtaaacatgggaaagtctaagccaagagatctaaagctctagaaatattaatgacatttctgggagtaaaactactaaaaattatatcttaaaagtttctagtagtatgaagttcccaggccaggcgcagtggctcacgcctgtaatcccaacactttaggagggcgaggtgggcagatcacctgaggtcaggagtttgagaccagcctggccaacatggtgaaactccatctctactaaaaatacaaaaattagccgggcatgatggcaggcacctgtaatctaagctactcgggaggctgaggcaagagaatctcttgaacccaggaggcaaaggttgcagtgagccaagatcacgccatcgcactccagcctgggagattgagcaacttcgtctcaaaaaaaagtttccaggaaagatctttgggtcctactaagcgtctcaattttgagttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatgaagaaagccctggcagatacaaagttcctcagtatttaaggagaaggatctcttccatgtccccttgacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaacagacaaatgcttgtccttttggcgactc

SEQ ID NO: 5300 - DNA, 11239 bp, Homo sapiens
atgtctgcttgtaacacctttactgaacatgtttggaaacctggtgaatgcaagaattgctttaaacctaaaagtttgcaccagcttcccccagaccctgagaaggcacccatcacccatggcaatgtgaaaactaatgccaatcacagtaacaaccaccgcatcaggaacacgggcaatttccggcctcctgtggctaaaaaacccactatagctgtgaagcccactatgatagtggcagatgggcaaagtatatgtggtgagcttagcatccaagaacactgtgagaacaaacctgtcatcatagggtggaaccgaaacagagctgccttgagtcagaaaccacttaacaataataatgaagatgatgaaggaattagccatgttcctaagccttatggcaataatgatagtgcaaagaagatgtcagataacaataatggactaactgaagtgttaaaggagatagcaggcttggatactgcccctcagataagaggaaatgaaacaaactccagagaaacattcttgggaagaataaatgattgctataaacgatcattggaaagaaagcttccaccaagttgcatgataggtgggataaaggaaactcagggcaagcatgttattctgagtgggagcacagaagtgattagtaatgaagggggccggttctgttacccagagttttccagtggcgaggagagtgaagaggatgtacttttcagtaacatggaggaggagcacgagagttgggatgagagtgatgaagagctgttggccatggagattcgcatgagagggcaacctcgctttgccaacttcagagcaaacacattgtctcctgttcgattctttgtggacaaaaaatggaataccatccccctgcgaaacaagtctctgcagagaatctgtgctgtggactatgatgacagctatgatgaaatcctgaatggttatgaggaaaattctgtggtctcttatggacaaggaagcattcagagcatggtgtcatctgactccacatcaccagattcttctttaacagaagaatcacgttctgagacagccagtagtttatcccagaagatttgtaatgggggattatctcctggtaacccaggagattctaaggacatgaaggaaattgagcccaattatgaaagtccctctagtaataatcaggataaagattcatcacaggcttccaaaagctcaataaaagttccagagacccacaaagcagtccttgctctccgattagaagagaaagatggcaagattgctgtacaaactgagaaggaagaaagtaaagcctctacagatgttgctgggcaagcagtaaccataaaccttgtccccacagaagagcaagcaaaaccttaccgagttgtgaacctggaacagccattgtgcaagccatatactgtcgtggatgtgtcagcagccatggccagtgagcacctcgagggccctgttaacagccccaagacaaaaagctcatcctctactccaaactctccagttacatcatcttcattgacaccaggacaaataagtgcccatttccaaaaatccagtgcaattcgataccaagaagtatggacttctagcaccagtccacgacaaaagatacctaaagtagaactaattactagtggaactggaccaaatgttcctccaaggaaaaactgtcacaaatcagcacctacatcacccacagctacaaacatttcctccaaaaccatccctgttaagtcacctaatttgtctgaaattaaatttaatagttataacaatgctggtatgccaccttttccaattatcattcatgacgagccaacttatgctcggagttccaaaaatgctatcaaagttcccattgttatcaatccaaatgcatatgacaatctagctatctacaaaagttttctgggaacaagtggagaactctcagtgaaggaaaaaaccacaagtgtaataagccatacttatgaagaaatagaaacagaaagcaaagtgcctgataacaccactagcaaaaccactgactgtcttcaaactaaagggttttcaaacagcacagagcataaaaggggctcagtggctcagaaggttcaagagtttaacaactgtctcaacagaggtcagtcttcaccacagagaagctatagttccagccacagctccccagcaaagatccagagagccactcaagagcctgtggccaaaatagaaggcactcaggagtctcagatggtgggcagcagcagcaccagagagaaagcaagcacagtgctttctcagattgtggcttcaatccaacccccacagtctcctccagaaacacctcaatctggccctaaagcttgcagtgtggaagagctttatgccattcctccagatgctgatgttgctaagagcacacctaagagtacgccagtccggcccaaatctctctttacatctcagcctagtggtgaggctgaagcacctcagaccacagacagtcctaccaccaaagtacagaaagacccatccataaagccagtcaccccctctccctccaaattagtgactagcccccaaagtgagccaccagctccctttcccccgccacgctctacttcttctccttaccatgcaggtaaccttttgcagaggcatttcaccaactggaccaagccaaccagccctaccaggtcaacagaagctgaatcagttttgcactctgaaggcagcaggcgggcagctgatgcaaaacctaagcgctggatatcatttaaaagcttcttccgccgtcggaaaacagatgaggaggatgacaaagagaaagagcgagagaaagggaaactggtgggcctggatggcacagtcattcacatgctgcctcctcctccagttcagcgccatcactggttcacagaggcgaaaggagagtccagtgagaaaccagccattgtcttcatgtacaggtgcgaccctgctcaaggccagctcagtgtggatcagagcaaggctaggacagaccaggcagcagtcatggagaagggtagagcagagaatgcattactacaggactcagagaagaagaggagtcattcttctccatcacagattcctaaaaagattctcagtcacatgacccatgaagtaacagaggatttttctcctcgggatccaagaactgttgttgggaagcaagatggcaggggctgcacttcagtcacaacagcattgtccctacctgaactggaaagggaagatggaaaagaagacatttcagatcctatggacccgaacccttgtagtgcaacatacagcaacttagggcaatctagagcagccatgatacctcccaagcagccacgacagcccaagggagctgtggacgatgccatcgcctttggagggaaaacagaccaagaagcacccaatgcttcccaacctacaccacccccactgccaaagaagatgatcataagagccaatacagagccaatctccaaggacctccaaaaatccatggaaagtagtctttgtgtcatggctaatcccacctatgatatcgaccccaactgggatgccagcagtgctggttcttccatcagctatgaactcaaaggactggacattgagtcttatgactccttggaaaggcctttgcgcaaggagagacctgtcccctcagcagcaaacagcatttccagcttaaccactctcagtattaaggatagattttccaacagcatggaatccctctccagccggcgtgggccctcttgcagacagggccgaggcatccagaagccgcagagacaagcactttatcgaggacttgagaatcgggaggaagtagtgggtaaaatccgaagccttcatacagatgccttgaagaaactggctgttaaatgcgaagaccttttcatggctgggcagaaagaccagctccgttttggagtggacagctggtcagacttcaggctaaccagtgacaaaccatgttgtgaggcaggtgatgcggtttactatactgcttcatatgcaaaagatccacttaataactatgcagtcaagatctgtaagagcaaagctaaagaatctcagcagtattatcacagcttggctgtccggcagagtctggctgtccattttaacattcagcaggactgtggtcatttccttgctgaagtccctaaccgtctgcttccctgggaggatccagatgaccctgaaaaggatgaggatgacatggaagagactgaagaagacgccaaaggagaaacggatgggaaaaacccaaagccctgttctgaagcagcatcatcccagaaagagaatcagggagtcatgagcaagaagcagaggagccacgttgtggtcatcaccagggaggttccatgtcttactgtggctgattttgtgcgagactctctggcccagcatgggaaaagccctgatttgtatgagaggcaggtgtgtctgctgctcttacagctatgctctggtcttgagcacctcaaaccctaccatgtcactcactgcgatctacgcctagagaacctgctacttgtccactaccagcctggggggactgcccaaggctttgggcctgcagagcccagccccacctcatcttatcccactaggcttatagtgagcaacttctctcaggccaagcagaagagccatctggtggaccccgagatcctccgggaccagtctcgccttgccccagagatcataacagctacccagtataaaaagtgtgatgagttccagacaggcatcctcatctatgagatgctgcacctacccaacccctttgatgagaacccagagctgaaggagagggaatacacacgagcagacctgcctcgcatcccattccgctccccctactcccggggtctgcagcagctggccagctgcctcctgaatcccaacccttctgagcggatcctcatttcagacgccaaaggcatcctccagtgtctgctctggggcccccgcgaagatctcttccagactttcaccgcctgccctagcctagtacagaggaacaccctgctccaaaactggctagacatcaagcgaacactgctcatgatcaagtttgctgagaagtccctggacagggaaggtggaatcagccttgaggactggctttgtgctcagtatttggcttttgccactacagactccctcagttgtattgtgaaaattctgcagcaccgttaatgtgtacctggatgatgcttttactacatcttcaccttcttcatgtcacccatgcacttcccctccctagtgctcactccaaattcaaggaaagaagaaaggcaaacctctatccctgtccgtgaacaagtgggtctattcagaaaggttatccactgccccagattgaatgagaagctgagtctgtcttaactttacagaaattcagctgcacaaacttgcagttgccttcccttgaaacaccttctatcctaatagtcccataaatgcaggtaaaaatgaaaatccatattcttgaagggacagcttctttggtatgaactcagccagtgagctgtgtccatttcctccataattctggatatcacctatctttttagcaccaagtatttattctcactagcagtagacagacttaaccagtctctaccacgacccagtagactctgacaacagactcttcctttaaggtgtcaacaactgacttactaggcaggactgccatccttagcatcagcccagttttggttaccagggactatatcttttgttccaggagagagtagaaagaaaaggagagatcccatccttgggtcatagacccattttcattgccattatctgtaagtatgtgcactgcatggaggacagccctaatagtctcccctctgctgccactgcctgattctccactctgtccccacttgccagtgaagtttggatttatcagccacttgtggcccattacagagctgacccaaggtggtgtcaccaatgcctcagcagggtggagtgcagttcagagcttataaatagctggcagggcatgaggagatgattttcttgcatgtgcaattctctaggggccatcaggaaacagagtttaaagtaccctttgattactgtcagaactgtcagcatttgcagttttccccgagcagtaattggccagctcccttctatcagtagccagtgttaactagtttaccaaatgctgtaaacaattgccctgaatgaaatagctgtcagtggagctctaagatctcctttagagggcacagtgaggtgggctgttgggatggccgtaggcaggggagaggaagaaggccactgatgagactgctgacctcctcagaaggttgacctcttctagagagactgcctcccagtgtttaagtggctcattgctccttctgactctgtaaaatggctctggaggacagctcacaggaattctgattgctgaggtgggtgattgagagctgttcaccatgtgtgcagcctgtgctccccttctatggatatgtgtgcaatttttgtatgtatttttttagctgtatattacagtgtttatgttgcaacttcacctgaagcgagtctacagaaaccctcccccttcttcccttggcacatatttgcgctaagagatgagcgttccttccactggggttgtgtgtgtgtgtgtgtgtgtgtgtgtgtgtgtgtgtgtgtgtgtatgtatacacatgttcacctgtgcttgttttattcaaaactgtgagtatgtgtttactttgaccttgaaatcccaagagtcactcgaacaatgtgtgtgtacacttgtgtgcccatgtgtgcgtgcacacgcatgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatctttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagccagagaaaagcctcaggcttcccagagacaggtggctagattaatttttctctgggtgatggccaaagaatgtgagatagagagggaagggggtgttacaggttagagcagaatagagaaagaaactatatttctaggcaaaaagtactacatgagttggtcttcagaatatttttccaaaaaaatgaaattcagtcagtttaacattatcacaaatatttttcattttaattgtggtaggacctttgaatttgttcatcaactggaaagaaatcctaccctctgtagacacatacacacacatttatatatctatgtgtttgaattgtgactagtatagcactttacattttctcaagtaacaggaagttattgccttcaatattgattggaaattgttttctattgaagtctatactgtagagttttccatttatattgagagtttgaacaattaagctcctattggaacttttccttaagccacatgagcatgaacaatctctgtgacacttgggtgctagagaaacacaacagtggctaaagtagccaagagcaagactgaatgtatagcagagtgccttgttagagtggtaacctagtcttggaagcaattcagtggatgtttcataaagaggactagaacttcaagaagcctcctgtgctggctgaggtgagcccttttggtatatgtacactactgggttgcctagaagccaattcatgaagaataacagcaggatgagaaaaagagtcactgtaacctgtggaacaacaacgtaagaatcaccaacccctaggctgagctagaactggaagccaggaatatggcaatgagtttcaagatttgccctcagaagatgaactgggtgaggtatgggttgaggtgagggcacaagcactcatcctacctaccctgctgctgttgaggagctagaagtaaaacatattggttaggattttaacagttggagtagcctcccattatcagattaagtgggggtcacttttgcttccaaactcagaataagtttgtaaacatgggaaagtctaagccaagagatctaaagctctagaaatattaatgacatttctgggagtaaaactactaaaaattatatcttaaaagtttctagtagtatgaagttcccaggccaggcgcagtggctcacgcctgtaatcccaacactttaggagggcgaggtgggcagatcacctgaggtcaggagtttgagaccagcctggccaacatggtgaaactccatctctactaaaaatacaaaaattagccgggcatgatggcaggcacctgtaatctaagctactcgggaggctgaggcaagagaatctcttgaacccaggaggcaaaggttgcagtgagccaagatcacgccatcgcactccagcctgggagattgagcaacttcgtctcaaaaaaaagtttccaggaaagatctttgggtcctactaagcgtctcaattttgagttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatgaagaaagccctggcagatacaaagttcctcagtatttaaggagaaggatctcttccatgtccccttgacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaa

SEQ ID NO: 5301 - DNA, 5933 bp, Homo sapiens
gactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaaacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagatcgtaaacgaagtgccagtgcacccaccctagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 5302 - DNA, 6001 bp, Homo sapiens
ggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaatctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 5303 - DNA, 875 bp, Homo sapiens
gtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggtatgtgcagaggccagaaccaagatgggatttccctgctgaactatgtgagatgctgcatttctatgttgtgtttgctctgatgcagcagtaagtttcttgattcatttagaccagcacattaaaaaaaaaaaa

SEQ ID NO: 5304 - DNA, 559 bp, Homo sapiens
ccggctccaatccctggatggctttaagtccagcaaacctttctgtttttcctatcgctcttctctttgcttaacctctcctctttcctccagacccacttaaaagcagttcatcaggaaaacttagctgacagtctcagtcagaactcactcgtgcaggaactttgcaggaagcagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttc

SEQ ID NO: 5305 - DNA, 5719 bp, Homo sapiens
cagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaatctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctc

SEQ ID NO: 5306 - DNA, 609 bp, Homo sapiens
tgtgtgcattgaaacagcagccttaaggtctttaaacggggaaatacatttttcttgcttcagagattcaattttacttgcccgagaagcttgtgtggtgtgattttcatcgctaaaagcaacagcagccacatggctgacaacaccaccacttaacaattcaaagctcggtcaccgttttcaggagtctcttccaaatctttctgaagtgcttttgaagttctacattccccgtctaagggaacacccagcagtcccaggataaaagggcagaaggtataaaagaacgtgtggatcactttgctgagtacatccaagatttgaagaactgaaataaatcagctttaaacctgctttttaaaaatacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatc

SEQ ID NO: 5307 - DNA, 3208 bp, Homo sapiens
agtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttga

SEQ ID NO: 5308 - DNA, 6082 bp, Homo sapiens
gattcctgcagggagggaggagagaagggcggcagtgggagggggaggtacctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggcaatggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaaacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagatcgtaaacgaagtgccagtgcacccaccctagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctc

SEQ ID NO: 5309 - DNA, 1191 bp, Homo sapiens
ggcagtgggagggggaggtacctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaa

SEQ ID NO: 5310 - DNA, 2031 bp, Homo sapiens
cagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaata

SEQ ID NO: 5311 - DNA, 1834 bp, Homo sapiens
gactcatgtgcccgcagctagcaggagctggcagcatgggctccccaggggctacgacaggctgggggcttctggattataagacggagaagtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcagggagagaacgtgttcttcttggtgaccaacttccttgtgacgccagcccaagttcagggcagatgcccagagcacccgtccgtcccactggctaactgctgggtcgacgaggactgccccgaaggggagggaggcacacacagccacggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggc

SEQ ID NO: 5312 - DNA, 1494 bp, Homo sapiens
atggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggggggcagcgtgttcagcatcatcaccagggtcgaggccacccactcccagacccagggaacctgccccgagagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtggtaaggaaccctctctggggtcccagcgggtgcggggggtccaccaggcccttacacaccggtctctgctggccccagggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctga

SEQ ID NO: 5313 - DNA, 1222 bp, Homo sapiens
atggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggggggcagcgtgttcagcatcatcaccagggtcgaggccacccactcccagacccagggaacctgccccgagagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaagatggtggacactcctgcctccgagcctgcccaagcctccacacccacagaccccaaaggtttggctcaactctgagctcctt

SEQ ID NO: 5314 - DNA, 1344 bp, Homo sapiens
atggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgagagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctga

SEQ ID NO: 5315 - DNA, 1140 bp, Homo sapiens
atggccgccgcccagcccaagtaccccgccggggcgaccgcccggcgcctggcccggggctgctggtccgccctctgggactacgagacgcccaaggtgatcgtgagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctga

SEQ ID NO: 5316 - DNA, 1200 bp, Homo sapiens
atggccgccgcccagcccaagtaccccgccggggcgaccgcccggcgcctggcccggggctgctggtccgccctctgggactacgagacgcccaaggtgatcgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctga

SEQ ID NO: 5317 - DNA, 1867 bp, Homo sapiens
ctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggggggcagcgtgttcagcatcatcaccagggtcgaggccacccactcccagacccagggaacctgccccgagagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaaccttgaatctgcccagactcttcccttagaagtcacaacatactcagtccaataaacctgtgagcag

SEQ ID NO: 5318 - DNA, 1113 bp, Homo sapiens
atggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgagagcataagggtccacaacgccacctgcctctccgacgccgactgcgtggctggggagctggacatgctgggaaacggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaaggcaggggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaagatggtggacactcctgcctccgagcctgcccaagcctccacacccacagaccccaaaggtttggctcaactctga

SEQ ID NO: 5319 - DNA, 2309 bp, Homo sapiens
tccgcgatcgctgctttcagctgggcaacagcacagggcggtcctgcgcatccggggggctgcgctcccagaccggtggctggggagtaggttgcaggggtgtcactgtgtcaggggaggaggaggaggaggaggaagaagaggtagcggcaaggtcgcggtctgaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaa

SEQ ID NO: 5320 - DNA, 1508 bp, Homo sapiens
gctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggctgaggactccctctgcttctcccttacaccaggaatga

SEQ ID NO: 5321 - DNA, 1998 bp, Homo sapiens
cgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaacaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaa

SEQ ID NO: 5322 - DNA, 1863 bp, Homo sapiens
ggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaacaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaa

SEQ ID NO: 5323 - DNA, 1536 bp, Homo sapiens
cttgtcgcctctgctgcttgcaggactgggtttcagtcagcagtgggagctgtggcccctgcccaggagctggtgggacaggtggagccctgagcctgctccacctcaactaggagttgctgtgactgctaccccaccccaaggcctggggaagctccccgaagccagcagagtggctgatgcccacgtaccggcccccttcccacagatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcacta

SEQ ID NO: 5324 - DNA, 3554 bp, Homo sapiens
ctgccatgctgactcatgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcagggagagaacgtgttcttcttggtgaccaacttccttgtgacgccagcccaagttcagggcagatgcccagagcacccgtccgtcccactggctaactgctgggtcgacgaggactgccccgaaggggagggaggcacacacagccacggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaggcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggactggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaa

SEQ ID NO: 5325 - DNA, 2512 bp, Homo sapiens
gctgcagctgccatgctgactcatgtgcccgcagctagcaggagctggcagcatgggctccccaggggctacgacaggctgggggcttctggattataagacggagaagtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagcc

SEQ ID NO: 5326 - DNA, 3687 bp, Homo sapiens
ctgggattaggggttgagggctgggtgttggaggctggatctggatcctgctttagtggaagtgtccctttaacagcaactggcctggcctggctcgggccctgctttgcctcctgttcagctgcggctgcagctgccatgctgactcatgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcagggagagaacgtgttcttcttggtgaccaacttccttgtgacgccagcccaagttcagggcagatgcccagagcacccgtccgtcccactggctaactgctgggtcgacgaggactgccccgaaggggagggaggcacacacagccacggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaggcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggactggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaa

SEQ ID NO: 5327 - DNA, 2513 bp, Homo sapiens
gctgcagctgccatgctgactcatgtgcccgcagctagcaggagctggcagcatgggctccccaggggctacgacaggctgggggcttctggattataagacggagaagtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagcca

SEQ ID NO: 5328 - DNA, 2149 bp, Homo sapiens
ctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcagggagagaacgtgttcttcttggtgaccaacttccttgtgacgccagcccaagttcagggcagatgcccagagcacccgtccgtcccactggctaactgctgggtcgacgaggactgccccgaaggggagggaggcacacacagccacggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagcc

SEQ ID NO: 5329 - DNA, 1714 bp, Homo sapiens
tgccgccagagtaaagctttctaccctttactccctgcaaagaaacaagagtgcttatcccagctaagctccagggtaatgttatcatgacagcttcaacttttagaccacaggcaaatgctttgttaaaactctatgctggtcattcccttcaggatttggcactcaccaacatacccttctttcaagtgaaaaggcatctcttttaatggtcctgacctttggaataggaagcatgtaccctggacagagcacttcaaactagaggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggatacaagcaaatgaatgcagttgcgttggtcgggatgattacagttgctgagcttgcaggatttgtgatcccagtgatcatcatcgcatggtgtacctggaaaactactatatccttgagacagccaccaatggctttccaagggatcagtgagaggcagaaagcactgcggatggtgttcatgtgtgctgcagtcttcttcatctgcttcactccctatcatattaactttattttttacaccatggtaaaggaaaccatcattagcagttgtcccgttgtccgaatcgcactgtatttccaccctttttgcctgtgccttgcaagtctctgctgccttttggatccaattctttattactttatggcttcagagtttcgtgaccaactatcccgccatggcagttctgtgacccgctcccgcctcatgagcaaggagagtggttcatcaatgattggctaaaattaagatatctctttaattacgcctttgtttacctacgttccttgtctttttccaaaggccagaattgtcaaccaatttctttaattgaacattgtaaaaaacaggaataagtacttttgtgtaatattcacagtcaacaggggtgtgatggtgaaggcagagtgtgaaaaacgtgagagaggaagagaaaatagatttacctgattcctctttaaaattcaagccactttcttatttaagaaacctagatcaagtttttacagatgtaaataaaagttgaatagtttaccttaaatttttttcaataagtaagttattgttaataatgcacagtaaatatgtgaatttttcctagatgtaaaaaaaaaaatctttcatataaagaccttaaattctgagtgagagtaaaaa

SEQ ID NO: 5330 - DNA, 1597 bp, Homo sapiens
tttgtgcaaataaggtttctgtggtgagacaccagataaactcaacttcctctttcaacaacaaatgtgtcagttatcagcaggatccatgccgccagagtaaagctttctaccctttactccctgcaaagaaacaagagtgcttatcccagctaagctccagggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggatacaagcaaatgaatgcagttgcgttggtcgggatgattacagttgctgagcttgcaggatttgtgatcccagtgatcatcatcgcatggtgtacctggaaaactactatatccttgagacagccaccaatggctttccaagggatcagtgagaggcagaaagcactgcggatggtgttcatgtgtgctgcagtcttcttcatctgcttcactccctatcatattaactttattttttacaccatggtaaaggaaaccatcattagcagttgtcccgttgtccgaatcgcactgtatttccaccctttttgcctgtgccttgcaagtctctgctgccttttggatccaattctttattactttatggcttcagagtttcgtgaccaactatcccgccatggcagttctgtgacccgctcccgcctcatgagcaaggagagtggttcatcaatgattggctaaaattaagatatctctttaattacgcctttgtttacctacgttccttgtctttttccaaaggccagaattgtcaaccaatttctttaattgaacattgtaaaaaacaggaataagtacttttgtgtaatattcacagtcaacaggggtgtgatggtgaaggcagagtgtgaaaaacgtgagagaggaagagaaaatagatttacctgattcctctttaaaattcaagccactttcttatttaagaaacctagatcaagtttttacagatgtaaataaaagttgaatagtttaccttaaatttttttcaataagtaagttattgttaataatgcacagtaaatatgtgaatttttcctagatgtaaaaaaaaaaatctttcatataaagaccttaaattctg

SEQ ID NO: 5331 - DNA, 2764 bp, Homo sapiens
ctcatttgtaggctgaactaatgactgccgccataagaagacagagagaactgagtatcctcccaaaggtgacactggaagcaatgaacaccacagtgatgcaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgataatgacactcatgcttcctttcaaaatcctctctgactcacacctggcaccctggcagctcagagcttttgtgtgtcgtttttcttcggtgatattttatgagaccatgtatgtgggcatcgtgctgttagggctcatagcctttgacagattcctcaagatcatcagacctttgagaaatatttttctaaaaaaacctgtttttgcaaaaacggtctcaatcttcatctggttctttttgttcttcatctccctgccaaatacgatcttgagcaacaaggaagcaacaccatcgtctgtgaaaaagtgtgcttccttaaaggggcctctggggctgaaatggcatcaaatggtaaataacatatgccagtttattttctggactgtttttatcctaatgcttgtgttttatgtggttattgcaaaaaaagtatatgattcttatagaaagtccaaaagtaaggacagaaaaaacaacaaaaagctggaaggcaaagtatttgttgtcgtggctgtcttctttgtgtgttttgctccatttcattttgccagagttccatatactcacagtcaaaccaacaataagactgactgtagactgcaaaatcaactgtttattgctaaagaaacaactctctttttggcagcaactaacatttgtatggatcccttaatatacatattcttatgtaaaaaattcacagaaaagctaccatgtatgcaagggagaaagaccacagcatcaagccaagaaaatcatagcagtcagacagacaacataaccttaggctgacaactgtacatagggttaacttctatttattgatgagacttccgtagataatgtggaaatcaaatttaaccaagaaaaaaagattggaacaaatgctctcttacattttattatcctcgtgtacagaaaagattatataaaatttaaatccacatagatctattcataagctgaatgaaccattactaagagaatgcaacaggatacaaatggccactagaggtcattatttctttctttctttttttttttttttaatttcaagagcatttcactttaacattttggaaaagactaaggagaaacgtatatccctacaaacctcccctccaaacaccttctcacattcttttccacaattcacataacactactgcttttgtgccccttaaatgtagatatgtgctgaaagaaaaaaaaaacgcccaactcttgaagtccattgctgaaaactgcagccaggggttgaaagggatgcagacttgaagagtctgaggaactgaagtgggtcagcaagacctctgaaatcctgggtaaaggattttctccttacaattacaaacagcctctttcacattacaataatataccataggaggcacaagcaccattattaagccactttgcttacaccttaagtgtgtacaattcaagtgtgagaatgctgtgttaactattctttggaattctccttctgtccagcaaatactctaatgatggttaaacatggcacctactcagcaatgccttcctggaccacaacccctatccccctgccccaccctcctcattaaaaacaaatacttctactgtttgggtgtgtgatagggttctcaatgcagatctcccttttctagttagctatattcttgactgcatccgctaaaaatgttaaagcttcttgagagacagacatgccagattttcttggtatctcccataatacgacctacagtccatggtctacagatgttttaaatagaattgctattctcgatacatacaaagacgtaattgctgacccacaatcagtaacatccatattgagagatttttcaaaggatggtgaccctgcttgtatttatttaccttggtattttttcttgcatccttctgtgattcaaaaaagtaaaatgtggctttctgaaatgatggataagagtctacatcttctagaaaaaatacataaaggagtagttaagctctgtaaatgtgccacgagctccaacacgaccatcgtagggtgaagcccacgttttcttccatggcctcaaaggccctagaacttgcctacctttctggccttacctcctagctacttatccatctcttgaactttatactcttgtataaatttctaactttcagaaaatgccatactctgttttggcaccacacatgtatatttccccctggtacacttggaagactcttatccatctgtgaaaccctatgttgtcatcacttggtccatgaaatattacctggccaatatcccaccatcacctcaaacccaatcaccccctcctctgtatgctgtcacacctatattattaaacttatcacattgcattgtaattacttcctgacctttgtatctactcttttagtaactgatgtatatatctgaaaggagagattgtttcattgtgcaatcaataaatgtttgataaaataaa

SEQ ID NO: 5332 - DNA, 2513 bp, Homo sapiens
aattctatctgacaacagcagcagagggacccactatcttgtggtttctgtcaagttcctgattttcatccgtagttgaagatgagcaagaactctgtaacagtgttaccttggagcctacaatgagaggtatttcaaaatgagtgaagcatgactctcacagatgaaggcctagacgcaggatctttaatgaaaaaacacttgggccacttcaagacgacaaacgctcactgggcaaaacaccttcactgaaaagagacctcatattatgcaaaaaaaatcttaaaaggcctctgccttcagaagttacaagatgatcaattcaacctccacacagcctccagatgaatcctgctctcagaacctcctgatcactcagcagatcattcctgtgctgtactgtatggtcttcattgcaggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggtctctgccgtgctcttctacgtcaacatgtacgtcagcattgtgttctttgggctcatcagctttgacagatattataaaattgtaaagcctctttggacttctttcatccagtcagtgagttacagcaaacttctgtcagtgatagtatggatgctcatgctcctccttgctgttccaaatattattctcaccaaccagagtgttagggaggttacacaaataaaatgtatagaactgaaaagtgaactgggacggaagtggcacaaagcatcaaactacatcttcgtggccatcttctggattgtgtttcttttgttaatcgttttctatactgctatcacaaagaaaatctttaagtcccaccttaagtcaagtcggaattccacttcggtcaaaaagaaatctagccgcaacatattcagcatcgtgtttgtgttttttgtctgttttgtaccttaccatattgccagaatcccctacacaaagagtcagaccgaagctcattacagctgccagtcaaaagaaatcttgcggtatatgaaagaattcactctgctactatctgctgcaaatgtatgcttggaccctattatttatttctttctatgccagccgtttagggaaatcttatgtaagaaattgcacattccattaaaagctcagaatgacctagacatttccagaatcaaaagaggaaatacaacacttgaaagcacagatactttgtgagttcctaccctcttccaaagaaagaccacgtgtgcatgttgtcatcttcaattacataacagaaatcaataagatatgtgccctcatcataaatatcatctctagcactgccatccaatttagttcaataaaattcaaatataagtttccatgcttttttgtaacatcaaagaaaacatacccatcagtaatttctctaatactgacctttctattctctattaataaaaaattaatacatacaattattcaattctattatattaaaataagttaaagtttataaccactagtctggtcagttaatgtagaaatttaaatagtaaataaaacacaacataatcaaagacaactcactcaggcatcttctttctctaaataccagaatctagtatgtaattgttttcaacactgtccttaaagactaacttgaaagcaggcacagtttgatgaagggctagagagctgtttgcaataaaaagtcaggtttttttcctgatttgaagaagcaggaaaagctgacacccagacaatcacttaagaaaccccttattgatgtatttcatggcactgcaaaggaagaggaatattaattgtatacttagcaagaaaattttttttttctgatagcactttgaggatattagatacatgctaaatatgttttctacaaagacttacgtcatttaatgagcctggggttctggtgttagaatatttttaagtaggctttactgagagaaactaaatattggcatacgttatcagcaacttcccctgttcaatagtatgggaaaaataagatgactgggaaaaagacacacccacaccgtagaacatatattaatctactggcgaatgggaaaggagaccattttcttagaaagcaaataaacttgatttttttaaatctaaaatttacattaatgagtgcaaaataacacataaaatgaaaattcacacatcacatttttctggaaaacagacggattttacttctggagacatggcatacggttactgacttatgagctaccaaaactaaattctttctctgctattaactggctagaagacattcatctatttttcaaatgttctttcaaaacatttttataagtaatgtttgtatctatttcatgctttactgtctatatactaataaagaaatgttttaatactg

SEQ ID NO: 5333 - DNA, 1780 bp, Homo sapiens
aagcatatattagagctgggctccaaagaatactggacatctgtagtacctgacattcaagcatttggcgagatgtcaatatttcagagagcactttaaatgttttgatttgaaagctaatgcagtgtttcccactggtcaacacgagcagtccagcagagagcaaaatctatttccctcaacatcaaatgctacactcagttgctgatcctatcttgcctacagagaacctaaaagactggaaaaattggatctttaatgaaaaaacacttgggccacttcaagacgacaaacgctcactgggcaaaacaccttcactgaaaagagacctcatattatgcaaaaaaaatcttaaaaggcctctgccttcagaagttacaagatgatcaattcaacctccacacagcctccagatgaatcctgctctcagaacctcctgatcactcagcagatcattcctgtgctgtactgtatggtcttcattgcaggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggtctctgccgtgctcttctacgtcaacatgtacgtcagcattgtgttctttgggctcatcagctttgacagatattataaaattgtaaagcctctttggacttctttcatccagtcagtgagttacagcaaacttctgtcagtgatagtatggatgctcatgctcctccttgctgttccaaatattattctcaccaaccagagtgttagggaggttacacaaataaaatgtatagaactgaaaagtgaactgggacggaagtggcacaaagcatcaaactacatcttcgtggccatcttctggattgtgtttcttttgttaatcgttttctatactgctatcacaaagaaaatctttaagtcccaccttaagtcaagtcggaattccacttcggtcaaaaagaaatctagccgcaacatattcagcatcgtgtttgtgttttttgtctgttttgtaccttaccatattgccagaatcccctacacaaagagtcagaccgaagctcattacagctgccagtcaaaagaaatcttgcggtatatgaaagaattcactctgctactatctgctgcaaatgtatgcttggaccctattatttatttctttctatgccagccgtttagggaaatcttatgtaagaaattgcacattccattaaaagctcagaatgacctagacatttccagaatcaaaagaggaaatacaacacttgaaagcacagatactttgtgagttcctaccctcttccaaagaaagaccacgtgtgcatgttgtcatcttcaattacataacagaaatcaataagatatgtgccctcatcataaatatcatctctagcactgccatccaatttagttcaataaaattcaaatataagtttccatgcttttttgtaacatcaaagaaaacatacccatcagtaatttctctaatactgacctttctattctctattaataaaaaattaatacatacaattattcaattctattatattaaaataagttaaagtttataaccactagtctggtcagttaatgtagaaatttaaatagtaaataaaacacaacataatcaaagacaactcactcaggcatcttctttctctaaata

SEQ ID NO: 5334 - DNA, 554 bp, Homo sapiens
aacagtgttaccttggagcctacaatgagaggtatttcaaaatgagtgaagcatgactctcacagatgaaggcctagacgcaggaattacctagcaagccatggccaccatccctcttaccctccacaattccaggatctttaatgaaaaaacacttgggccacttcaagacgacaaacgctcactgggcaaaacaccttcactgaaaagagacctcatattatgcaaaaaaaatcttaaaaggcctctgccttcagaagttacaagatgatcaattcaacctccacacagcctccagatgaatcctgctctcagaacctcctgatcactcagcagatcattcctgtgctgtactgtatggtcttcattgcaggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggt

SEQ ID NO: 5335 - DNA, 4778 bp, Homo sapiens
tgggaaataaagtcatttgtatgtttttctctcttgcacagcctaaaatgaccaatgtgtgatttcagtggaataaatggcgtccaaagtcacagatgctatagtctggtatcaaaagaaggagtttctctctgtggccaccaccgccccaggcccacagcaagtactgcctggctactgccagtgttcactcaaggaccaagggctcttcattcagtgtttgattggagcatatgatcaacaaatatgggaaaaatctgttgaacagagagaaatcaagtttattaaactggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgac

SEQ ID NO: 5336 - DNA, 4541 bp, Homo sapiens
ggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactga

SEQ ID NO: 5337 - DNA, 4793 bp, Homo sapiens
tccggcgcaaaatcctgcgggagagggggtggggcaaccctctggaggcagcgcgcccgcgggcagcctcgttgtggctccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactga

SEQ ID NO: 5338 - DNA, 5005 bp, Homo sapiens
aagtaaccagagtgctatgtctgcatgctgttcagtctccttttggaaggtgggaaataaagtcatttgtatgtttttctctcttgcacagcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaagtttattaaactggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactgacggtgtttttttttttaattttcaggtcatatacatttctatggtaattttgtgtttacttaacataaaatttagttagatttggggggagtgaaaataaattttttataactttccaacattttagattttgttatgattcttagaacatgaaagaataatacacaggtttttcatcaccaaaatgatattatatcattaatgtttgtttgcttctttgtttttgaatacagcaaactggctgtggcctgaaatattaaagctcattgtgaaaag

SEQ ID NO: 5339 - DNA, 3525 bp, Homo sapiens
tccggcgcaaaatcctgcgggagagggggtggggcaaccctctggaggcagcgcgcccgcgggcagcctcgttgtggctccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaagtttattaaactggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccacc

SEQ ID NO: 5340 - DNA, 5094 bp, Homo sapiens
agtgactgcaggctccggcgcaaaatcctgcgggagagggggtggggcaaccctctggaggcagcgcgcccgcgggcagcctcgttgtggctccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaagtttataaagtatgggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactgacggtgtttttttttttaattttcaggtcatatacatttctatggtaattttgtgtttacttaacataaaatttagttagatttggggggagtgaaaataaattttttataactttccaacattttagattttgttatgattcttagaacatgaaagaataatacacaggtttttcatcaccaaaatgatattatatcattaatgtttgtttgcttctttgtttttgaatacagcaaactggctgtggcctgaaatattaaagctcattgtgaaaag

SEQ ID NO: 5341 - DNA, 1738 bp, Homo sapiens
gggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggtatatactttgtccttaagtgtatacatacgtatctattttatatgttactaatttataacttctttcaacaattaaaaattgttgaaataaatatttcacattattatcaatatttattattgttgtatgatctggatttataaaatagcagttttaggtttacgtattgcacatgtattgatagatagccacacatttgagctcattttatgcattatctttgaagactcatacattgtttgttgtttgcttttaaagaagaacattctggagagagaatctgcaaactcctgtgttcactttttccacaatttgaaaggctttatacatttgatcatagcaaagttattttaagtaacttccttcatattgctgtcaccagttattaagtccccatacttcaaaattcagttcttttttctttgtttctatttttccttattaatctttattttctctaaacccttttcaactatatcatatctcttgagcttcaaattgtttaaataaagaatttcattcaattgtattttcagtttctaatctaagggtagaacatttggctttaaggcaaataaattacactgtttatcacttttttataaacatta

SEQ ID NO: 5342 - DNA, 2516 bp, Homo sapiens
aagtaaccagagtgctatgtctgcatgctgttcagtctccttttggaaggtgggaaataaagtcatttgtatgtttttctctcttgcacagcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaagtttattaaactggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggtatatactttgtccttaagtgtatacatacgtatctattttatatgttactaatttataacttctttcaacaattaaaaattgttgaaataaatatttcacattattatcaatatttattattgttgtatgatctggatttataaaatagcagttttaggtttacgtattgcacatgtattgatagatagccacacatttgagctcattttatgcattatctttgaagactcatacattgtttgttgtttgcttttaaagaagaacattctggagagagaatctgcaaactcctgtgttcactttttccacaatttgaaaggctttatacatttgatcatagcaaagttattttaagtaacttccttcatattgctgtcaccagttattaagtccccatacttcaaaattcagttcttttttctttgtttctatttttccttattaatctttattttctctaaacccttttcaactatatcatatctcttgagcttcaaattgtttaaataaagaatttcattcaattgtattttcagtttctaatctaagggtagaacatttggctttaaggcaaataaattacactgtttatcacttttttataaacattaccttctactctttttgagctatgttagtaattttttccttgatggttttgggttaaacttgtaaaacaaacacatgttacgctgtgctggaatatgattgccttcagagtattaagattagaagagttactattctttgcacactcttctttgtggttgtgtctctggttaatctttctggtgattgtggttttgtttcttttcccagtggttgccatacagacactaatgccagtgtgtctgctctattgcctcttcacccatgtcatttgatgtagtgtttcttgttcctaagccagataaccaagcttgtaaaattttgtcttactgtatgtactgttagaagtcagttggtgctggaagggagacggagggctgtttgacccctctcccagaataaattatttagcagtagcagtatttttctcactccatgatcttggcttttgttggtttgcaactgtattttaaacgattgagtttcttgaagcgcagaacattattctacctattaacttttaaattaaaaggttgtttaaaatcttgatttccagctaagtaaggctgatagtaagcattgatttacatcttttttaatgatataagaaattacataaatataaaatatggctataaaattcttcgtctataaagtgaagaatgtagactaggtgatattttaaaagctgcattcagttctcaaaaatttttactcttaaaccagctttaaagggcgtttctaaaaaaaagcaaaataaa

SEQ ID NO: 5343 - DNA, 1591 bp, Homo sapiens
agtgctccctatgaattgctgagggagagatacagcatagaaaaaaacaaggtgatgcgatggcgaggaagctcagtgtattggaagtccttctgatcatcttctgcttaattgtggtgaccatagatatcctcttgctgcttcttgtgttggaggaaacttcagatacttcatttactccagagtgcccagagattccccagtcggaaaggatagactgcacacctgaccaggaggtgaccgaggatatctgcagatggcaatataagtgctgctggtcgcctgtggcagatgccaatgtccctaggtgcttcttcccctggaactggggctatgaagccagcaatggccatacaaatacaagcacaggatttactgcccagttgaaaaggttgccatcaccatctctgtttggaaatgatgtcgccaccacccttttcacagctgaatatcagacatccaatcggtttcattttaagatcactgactttaataacatacgctatgaagtttcccatgaaaatattaacctggttgatgggattgctgatgcctccaatttgagctattacgtggaggttactgataaacctttcagcatcaaaataatgaggacaagcaacagaagagtcttgttggacacgagcatcgggcccctccagtttgcccagcagtacctgcaactgtctttccgactgcccagtgccaatgtgtatgggctgggagagcatgtgcaccagcagtaccgccacaatatgacctggaagacttggcccatcttcacccgggacgctacccccaccgagggcatgattaatctgtatggagctcatacattcttcttgtgccttgaagatgccaggggctcctcttttggagtatttctgatgaacagtaatgccatggaggttacccttcagccagctcctgcgatcacttatcgcacgattggaggcattcttgacttttacgtattcctaggaaacactccagaacaagtggttcaggaatacttggagcttgttggacggccattcttccctccctattggagtcttgggttccagcttagtcgcagggactatggtggcatcaataaattgaaagaagttgtaagccgaaatcgtttagctgagataccatatgatgtccagtactctgacatagactacatggatggaaagaaggatttcactgttgatgaagtcgcttactctggtctcccagattttgtcaaggagttacatgacaatggacagaaatatcttattattatgaatcctggcatctccaaaaactctaactacgagccctataataatggaagcctaaagagagtgtggatcttggggagcaatggctttgctgttggggagggatatccgggaccgacagtctttcccgattataccaatccagtatgcactgagtggtggacagatcaggtcgctaaatttcatgatcatctggagtttgatggagtgtggattgtaagttattattcctgactcaaatttcctttggaaacagataacgccaaattttcagatgagttttgaccttgatgtcaaataaatgtcaataaaaaata

SEQ ID NO: 5344 - DNA, 3538 bp, Homo sapiens
aataattaaggaggctttggaatcaactagacattccaaacacgttccaagtagctctggccagtggtctccagctcagcgtgatctgcttttgtgttgcagttgggattctcaactccctggcttcatcttcaatgacatgtttctctccatttctacgcgtctgccgtcccagtacatctatggctttggggaaactgagcacacgactttcagaagaaacatgaactggaacacatggggaatgtttgctcatgatgagccacctgcgtacaagaagaattcctatggtgtccacccttactacatggcactggaggaggatggtagtgcccatggagtgctcctgctaaatagcaatgccatggatgtgacattacagcccactcctgctctgacataccgcaccacaggagggattttggacttctacattgttttggggccaacccctgaacttgtaactcagcaatacacagagttgattggtcggccagcaatgattccatactgggccttgggattccatctgagtcgctatggataccagaatgatgctgaaatctccagtttgtatgatgcaatggtggcagcccagattccctatgacgtccagcatgtagacatcgattacatgaaccggaagctggatttcaccctcagtgccaactttcaaaacctcagtcttctgattgagcaaatgaagaaaaatggcatgagatttattctcattttggacccagccatttctggcaatgagacacagtatctcccattcattagaggacaggaaaataacgtgttcatcaaatggcctgacaccaatgacattgtctggggaaaggtttggccagatctgcctaatgtaattgtagatggatcccttgaccatgaaactcaggttaagctttacagggcctacgttgcctttcctgacttctttcgtaatagcacagctgcgtggtggaagaaagagatagaagagctctatgcaaaccctcgagagccagagaagagcttgaagtttgatggattgtggattgatatgaatgagccatcaaattttgtggatggatctgtcaggggctgcagcaatgaaatgctaaataacccaccctatatgccatatttggaatctagggacaagggcctgagcagcaagactctgtgcatggagagtcagcagatcctgccggacagctcccccgtggagcactacaacgtgcacaacctgtacgggtggtcccagaccagacccacatacgaagctgtgcaggaggtgacaggacagcgaggggtcatcatcacccgctccacatttccctcttctggacgctggggaggacaccggttgggaaacaacacagctgcatgggaccagctggggaaatctatcattggcatgatggagttcagtctctttggaataccttatacaggagcagatatctgtgggttctttggagatgctgaatatgagatgtgtgttcgctggatgcaactgggggcattttatccattttccagaaaccacaacaacatcgggacaaggagacaagatcctgtggcctggaattcaacctttgagatgttgtccagaaaagtcctagagaccagatataccctgcttccttatctctatactctgatgcataaagctcacgttgagggcagcacagttgtccggccccttctccatgagtttacggatgacaggacaacatgggatatagaccgtcagttcatgttgggccctgctatcttaatcagccctgtgttggaaactagcacatttgagatctctgcttattttccgagagcccgttggtatgactatagcacgggaactagcagcacatcaacaggtcagaggaaaatcctgaaggctccccttgaccacatcaaccttcatgtcagaggaggctacatcctgccctggcaagagcctgctatgaacactcactccagtcgacaaaattttatgggattgattgttgctttggatgacaatgggacagctgaaggccaggtgttctgggatgatggacaaagcattgtctttaacaccactgctatgtgaactcctatgactacatgcttgctgtctcgcacagaataaccaaacagtagtctccacacttcagatacctatgaaaatggaaattattttttggcaaactttatagcagctcagaacatcctgcaaatccagaccatacacaataagtatttgagtgactcgaatccactaaaagttgggtatattagaatctggggtgtgaatacctatgtgacacaagtcagtttcacctatgacaaccggcaatttatggagacaaatttcaagagtgaaccttataatcagatactaactattcaattgactgacaagactatcaacctggaaaagttaactgaggttacttggattgatggtggtcctgtacttcctactccaactaagacaagtaccatcccaatgagttctcatccttctccatctactaccaatgccaccagttctgagacaatcaccagttctgccagtgcaaatactaccactggcactactgatactgttcctatcacaaccacatctttcccaagtactactagtgttacaactaatactactgttcctgatacaacttctcctttccctacaactagtactgctagcactaatgctactgttcctatcacaaccacatgttttgcaacaagtactattggtgttacaactaatgctactgttcccgatacaactgcccctttcccaacaaatactactactgctagcactaatgctactattcctatcacaaccacactttttgcaacaagtactattggtgttacaactggtactactgttcctgatacaactgctcctttccctacaagtactactagtactagcactagtgctactgttcctattacaaccacaccttcccctacaaatactgctgatgctaacactagtaatactgttcctaataccactatgccttctcctacaagtagtactactgtgagtactattgctaccgttcccatttcagtgactccttctctgacaagtactgctgatgccaccattagtactactgtacttattgccactacttcttctctaacaggtactactgatgttagcactagtactactattaataatataagtactcctgttcaaacaaatactactaatgctagcactagtactaatgttgctaatataactgctacctctcatacaagtactgatgatactgttcctaataatactgttccagttacagctattccttctcttgcaaatactggtgttgacactactagcaacagtttttccattatgaccacttctttctctgaaagtactaatgctatgaacactactgttattatggcaactacttctcctacaagtactgatgttgctagcacaaataatgatgcttctatgacaaattttcttttagctacaatgtctgctggtaatataactagtaatagtatttccataacaact

SEQ ID NO: 5345 - DNA, 3660 bp, Homo sapiens
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctcttccaccctcagcggatgatctcaagacaccttccgagcgtcagctcactccccttccaccctcagctccaccctcagcagatgataatatcaagatacctggcttccaccatcagccgatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 5346 - DNA, 2280 bp, Homo sapiens
cggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 5347 - DNA, 3801 bp, Homo sapiens
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataat

SEQ ID NO: 5348 - DNA, 2316 bp, Homo sapiens
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 5349 - DNA, 2826 bp, Homo sapiens
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 5350 - DNA, 3798 bp, Homo sapiens
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggccgcttccaccctcagcggatgataatctcaagacaccttccgagcgtcagctcactccctttccaccctcagctccaccctcagcagatgataatatcaagacacctgccgagcgtctgcgggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataat

SEQ ID NO: 5351 - DNA, 3569 bp, Homo sapiens
tcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactcc

SEQ ID NO: 5352 - DNA, 975 bp, Homo sapiens
cgctgccctgtcagtcgcctgtgagctcctgctccttcctgggcctgcagccctggagaatttgctcaccgaggtaggagtgccgctgtgggcagtgggcggcggcagcggacgagcggccaggctgaccacctctgcctgactcagatgcctaagggccgggccggcagcctgcccacgacctccatcggctggcgcttccagctctggttcctaggactcacctgcccggagcgccacctggccagacgcctcaagaacaatagcttctacccatttgtgcagcaggagccaaacgtcttcgtgctcgaatactacctggacacactgtggaaggggatgctgctcttcatcatcagcgtggtcctggtcagcttcagctccctgagagaggtgcagaagcaagagacctgggtcttcctcgtgtacggcgtgggcgtgggcctgtggctcgtgatctcgtcgctgccgcggcgccgcctggtgctgaaccacacgcgcggcgtgtaccacttctccatccagggccgcaccgtgtgccagggccccttgcatctggtctacgtgcgcctggcgctcagctccgatgcccacggaaggtgcttcttccacctggtcctcggcggccacaggttggagcccctggtgctggtgcagctgtcggagcactacgagcaaatggaatacttgggccgttacatcgcccggaaactcaacatcaactacttcgactacctggccacctcctaccggcacgtggttcgccactggccaccccctggcgctggcactgtgatgggcaagagccccatgggtcacaagcccagctcctctcagtccagcctggaggtgtgactctgagggcctcccccacctcgggactgtgttctcggtaacctcccagccccactctggggcagatcaaatgtgagtcccactcactggccttcctttcaataaagctgcctcagcttc

SEQ ID NO: 5353 - DNA, 1596 bp, Homo sapiens
tctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttaggagttctgtgtgtgtggtcctcagggtagggttgggcaacaggttatacctgatggagccactggggctacagccggcccagagcctgtgtgttgtggggtcagggtggtcccatgggctcttgagcctgcaggtggccatgcctttgcctgcccactgctgggtccagtgtgtgtgttccgtcctcggggacactggtgagcttgtctgtggttgcatgtgggtggggggtgggagggggtggggccccgcccagctgtggggctcactgagtggtcgccgcctgcaaatttctctccagctcaggcctagggtgtccacccatccacccttcacatggggactgtgaacaggccatacagggggcctccagtggatggactggccaagaagttaatgcctaccgcaggacctcaccctggactccctaagaggtggtcaacagagcagccccttctagaacctgcccagaacttctagaacccatccgcggtccaccctgggccgctccctggcctcgctgccctgtcagtcgcctgtgagctcctgctccttcctgggcctgcagccctggagaatttgctcaccgagatgcctaagggccgggccggcagcctgcccacgacctccatcggctggcgcttccagctctggttcctaggactcacctgcccggagcgccacctggccagacgcctcaagaacaatagcttctacccatttgtgcagcaggagccaaacgtcttcgtgctcgaatactacctggacacactgtggaaggggatgctgctcttcatcatcagcgtggtcctggtcagcttcagctccctgagagaggtgcagaagcaagagacctgggtcttcctcgtgtacggcgtgggcgtgggcctgtggctcgtgatctcgtcgctgccgcggcgccgcctggtgctgaaccacacgcgcggcgtgtaccacttctccatccagggccgcaccgtgtgccagggccccttgcatctggtctacgtgcgcctggcgctcagctccgatgcccacggaaggtgcttcttccacctggtcctcggcggccacaggttggagcccctggtgctggtgcagctgtcggagcactacgagcaaatggaatacttgggccgttacatcgcccggaaactcaacatcaactacttcgactacctggccacctcctaccggcacgtggttcgccactggccaccccctggcgctggcactgtgatgggcaagagccccatgggtcacaagcccagctcctctcagtccagcctggaggtgtgactctgagggcctcccccacctcgggactgtgttctcggtaacctcccagccccactctggggcagatcaaatgtgagtcccactcactggccttcctttcaataaagctgcctcagcttc

SEQ ID NO: 5354 - DNA, 1070 bp, Homo sapiens
ggagtcggcggcggcagggattgtgggaaatgtagtttggagactccgccctcctcgccattcctgtaatggctgcttcctagaaggtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaactatagacattgacatggaaaagagatttaatgttttgaaaaaaaactttatattaactgagtaacatcctcctgatgagaagtactatattaaatataaacccattatgttataagttaa

SEQ ID NO: 5355 - DNA, 818 bp, Homo sapiens
ctagaaggtaatgtacgaactcgtctccaaaggatacttaggttgcaccagtgtatttgtaaaacaggagcaaatttggaccttgccgggccaaagtacgaattctttttcaaatcttaatatcaagtcctgaaatgaaattatctctgttctgtttctttttaccttttcttgtgtgggtgaactgaccaacttttaagtctagttccctgttggacagacttttctcaactcattacctatccccctaccgtccatatggcctccacgctctgcactgactctagctgcctctttaaaataataatagtaataataattaatttttaaatccttctctccgccccctccccaccccccatgctaataataggtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaa

SEQ ID NO: 5356 - DNA, 962 bp, Homo sapiens
ctcgccattcctgtaatggctgcttcctagaaggtaatgtacgaactcgtctccaaaggatacttaggttgcaccagtgtatttgtaaaacaggagcaaatttggaccttgccgggccaaagtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaa

SEQ ID NO: 5357 - DNA, 2010 bp, Homo sapiens
gcgcgccgtgcccgcggagagagcgcggcgcgggaggccggcggccggccggctgcatggcgcgctgcgagaggctgcgcggagcggccctgcgcgacgtgctgggccgggcgcagggggtcctgttcgactgtgacggggtgctgtggaacggcgagcgcgccgtgccgggcgccccggagctgctggagcggctggcgcgggccggcaaggcggctctgtttgtgagcaacaacagccggcgcgcgcggcccgagctggccctgcgcttcgcgcgcctcggcttcggggggctgcgcgccgagcagctcttcagctccgcgctgtgcgccgcgcgcctgctgcgccagcgcctgcccgggcctccggacgcgccgggcgccgtgttcgtgctgggcggcgaggggctgcgcgccgagctgcgcgccgcggggctgcgcctggccggggacccgagcgcgggggacggcgcggccccgcgcgtgcgcgccgtgcttgtgggctacgacgagcacttctccttcgccaagctgagggaggcgtgcgcgcacctgcgcgaccccgagtgcctactcgtggccaccgaccgtgacccatggcacccgctgagcgacggcagccggacccctggcaccgggagcctggccgctgcagtggagacagcctcgggacgccaggccctggtggtgggcaagcccagcccctacatgttcgagtgcatcacggagaacttcagcatcgaccccgcacgcacgcttatggtgggtgaccgcctggagaccgacatcctctttggccaccgctgcggcatgaccactgtgctcacgctcacaggagtctcccgcctagaagaggcccaggcctacctagcggccggccagcacgacctcgtgccccattactatgtggagagcatcgcagacttgacagaggggttggaggactgagcccactgcacctgcagccacaggcccacccctccccactccctgatcccgtaggtggaggcgatgggtcacgagccatgttaagcacaaccggctccttggtccagttctgcaccggggtggggctgggacccggggaaggtttgagggcccttgcaaccccctcccagcagtggctgggcactctttgctgccccagaagctggtcccctatggattcatcttggcctgacccagccaggtggccttatttcttccctgtcacctcccctccttgaaatctgggccctggtgcctgctgaagattccctctatccctgagtacttagtcttctcccccttccctggggcttctagagctctctctgcccctcaggtcctggcccttgggtccttgtcaaccagaggtctagggaaccacaacccttattgtcctgggtggaccaatccaaaggctaagtgatagtgactcatcaatgttgggtcctgtggggtaccagtttaggttcctaagtaatagtgaccctttcacgtcctggagcccgagtggaccaatcggaagcctaagtgacgatgaccctcgcatgtcctaggtccctgggtggacccatcaggaccccaagtgatagtgacccagtggtcttttagatcctcagtagaacagtccagaagcctgagagacagtggccccttgataatctgggtctcacgggaccagctaggggtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgtgccagtgatggtgggtgggggctgggccttccccgccacctccacccctgttgtgacctgtccttccgtacttaataaagtgcgcgtgggagtgttca

SEQ ID NO: 5358 - DNA, 1571 bp, Homo sapiens
atcactttcccgggggacgcggactgggtcagaggtgcgaacatttctgtgccccgctgtgttccaaaggggctgtgccagtttctaacgccagccgcgtgaattcctgcagcagtaaccacaactgctatttgttaagtgctgttccatttacaaagcacttgcccctgtgttgcccagcgcccgtttggaggcaccgggagcctggccgctgcagtggagacagcctcgggacgccaggccctggtggtgggcaagcccagcccctacatgttcgagtgcatcacggagaacttcagcatcgaccccgcacgcacgcttatggtgggtgaccgcctggagaccgacatcctctttggccaccgctgcggcatgaccactgtgctcacgctcacaggagtctcccgcctagaagaggcccaggcctacctagcggccggccagcacgacctcgtgccccattactatgtggagagcatcgcagacttgacagaggggttggaggactgagcccactgcacctgcagccacaggcccacccctccccactccctgatcccgtaggtggaggcgatgggtcacgagccatgttaagcacaaccggctccttggtccagttctgcaccggggtggggctgggacccggggaaggtttgagggcccttgcaaccccctcccagcagtggctgggcactctttgctgccccagaagctggtcccctatggattcatcttggcctgacccagccaggtggccttatttcttccctgtcacctcccctccttgaaatctgggccctggtgcctgctgaagattccctctatccctgagtacttagtcttctcccccttccctggggcttctagagctctctctgcccctcaggtcctggcccttgggtccttgtcaaccagaggtctagggaaccacaacccttattgtcctgggtggaccaatccaaaggctaagtgatagtgactcatcaatgttgggtcctgtggggtaccagtttaggttcctaagtaatagtgaccctttcacgtcctggagcccgagtggaccaatcggaagcctaagtgacgatgaccctcgcatgtcctaggtccctgggtggacccatcaggaccccaagtgatagtgacccagtggtcttttagatcctcagtagaacagtccagaagcctgagagacagtggccccttgataatctgggtctcacgggaccagctaggggtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgtgccagtgatggtgggtgggggctgggccttccccgccacctccacccctgttgtgacctgtccttccgtacttaataaagtgcgcgtgggagtgtt

SEQ ID NO: 5359 - DNA, 1708 bp, Homo sapiens
accctccaccgctccccaagcgggtccggcgtccgcatcgcatggccagaaggcggggagccagaggcgccaggaccctcgcgtggcgctccagcaccccagaccgtggcggcgcctcgccttagggaagagcaagggaagaactttatttgaaccgcgaacattttttggtcactgagatcgagtctcccagtgctttggcttcccgcctctttatcgtgggtttgatccctgagctgctctcctttcccgaacctcccggggtgcagcctagagccctcccgcgcggctgactccagagtagaggaagggaggcggcctccggctggtcccccgaagccctcgctgccccgcagatgcggatggccagccagtagcgggcggtggccccgcgtcccgggagcgcacagcaatgcaggcgcttaacattaccccggagcagttctctcggctgctgcgggaccacaacctgacgcgggagcagttcatcgctctgtaccggctgcgaccgctcgtctacaccccagagctgccgggacgcgccaagctggccctcgtgctcaccggcgtgctcatcttcgccctggcgctctttggcaatgctctggtgttctacgtggtgacccgcagcaaggccatgcgcaccgtcaccaacatctttatctgctccttggcgctcagtgacctgctcatcaccttcttctgcattcccgtcaccatgctccagaacatttccgacaactggctggggggtgctttcatttgcaagatggtgccatttgtccagtctaccgctgttgtgacagaaatcctcactatgacctgcattgctgtggaaaggcaccagggacttgtgcatccttttaaaatgaagtggcaatacaccaaccgaagggctttcacaatgctaggtgtggtctggctggtggcagtcatcgtaggatcacccatgtggcacgtgcaacaacttgagatcaaatatgacttcctatatgaaaaggaacacatctgctgcttagaagagtggaccagccctgtgcaccagaagatctacaccaccttcatccttgtcatcctcttcctcctgcctcttatggtgatgcttattctgtacagtaaaattggttatgaactttggataaagaaaagagttggggatggttcagtgcttcgaactattcatggaaaagaaatgtccaaaatagccaggaagaagaaacgagctgtcattatgatggtgacagtggtggctctctttgctgtgtgctgggcaccattccatgttgtccatatgatgattgaatacagtaattttgaaaaggaatatgatgatgtcacaatcaagatgatttttgctatcgtgcaaattattggattttccaactccatctgtaatcccattgtctatgcatttatgaatgaaaacttcaaaaaaaatgttttgtctgcagtttgttattgcatagtaaataaaaccttctctccagcacaaaggcatggaaattcaggaattacaatgatgcggaagaaagcaaagttttccctcagagagaatccagtggaggaaaccaaaggagaagcattcagtgatggcaacattgaagtcaaattgtgtgaacagacagaggagaagaaaaagctcaaacgacatcttgctctctttaggtctgaactggctgagaattctcctttagacagtgggcattaa

SEQ ID NO: 5360 - DNA, 952 bp, Homo sapiens
gcagccagtgagaaggccgtcaagatggcggcctcctggaggctgggctgtgatccgcggctgctgcgttatcttgtgggcttccccggccgccgaagcgtagggctggtgaagggggctcttgggtggtctgtaagccgcggagctaattggagatggtttcacagcacgcagtggcttcggggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtgcaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtgga

SEQ ID NO: 5361 - DNA, 2389 bp, Homo sapiens
gggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccccggccgccgaagcgtagggctggtgaagggggctcttgggtggtctgtaagccgcggagctaattggagatggtttcacagcacgcagtggcttcggggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaa

SEQ ID NO: 5362 - DNA, 2503 bp, Homo sapiens
aaacgcccggcccgctaccctgcgcccagctccagccgccgggtcccgcctgggcctctcctcctgggaataccgggcaccggtggccccgcccctacctgcgcgccgcatctccgggaacaacagtctccctcccgagcatcacagccagacatggcccagaccagggacccgcgcggcctccaatctccgcacggctttgcgcgcggcgcttagcctgggatacggcagcgaggccgcaaatgcaatcaggcggcgctgagggcagcccgggggcggggcgaacggggcgggggccggggtctggtaaggccccgccggctgagatatccagcggcgcacctgacttcccgggaggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaa

SEQ ID NO: 5363 - DNA, 1809 bp, Homo sapiens
gcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctagacccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactcactgttccaggaattcttgcagtgtagaggtattcacaacagcaagcagggatttggcctgccatcaattttatttaaaaagcaattaagtttgcagtttgtcctcataaacgttgtaggttgaaactgaaaaataagttaaaatgatcaatcaagataaaaggtgatctatccatccaatggaatattatttggccttaaaaaggaaggacattctgatatgtgctgcaacatgggtgaatcttgaagtcattatgctaagtgaaataaaccagacataaaaggacaaatac

SEQ ID NO: 5364 - DNA, 1921 bp, Homo sapiens
atgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctagacccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacaagacaagatcaagactaatagaactttctagaggactgaatgctgtggtcctctctgtgaagaaagattgccttctgcaagtcaaacagagagaactgctttctcccacctgctctgagcgtggcatcacagttattcctagtgcttaaatgtgtattttctctctaccacctggactttcccaaagagtttttcctgtagctactccagatcttccactaaagtagtaactttttaatgacatcttgctgtggtgtgattgatgcctgtcaccgaagagcacagagcctccttacagctcttgtgccctcgtactctccatcttgttatcatagcatctgatgtcttcagtccttccaggattctgtgcgcctttcccattccagatacagcagatcgtactgttgctccttgtgaccaaataccatatttgtcccaaacctccacctagggccctgggaccctgaaagtggaagacatcaggtggccatgccctgatgatttagtcccagagccctccgtctctcccgtgcctccctccgccactctatgatttagacttttgccttcttccatctgatcggattctcattgtgagatgtggtgactttcatgttagatcttcttcattgatgccttggttttattttaaaattcatttgtatatgtctgttgattaaagcattcgaaatgttatcttagaa

SEQ ID NO: 5365 - DNA, 3830 bp, Homo sapiens
gactagggaccgcctgggtgaggtgaggacctggtggccgcagttgtggcactgtgcgcaggcgctgaactgaccggacggagcgggcggctgtggcctcgccagctggtttaaaaatatccttttttgctgaaggaacacatttgctggtatagtttcagaatgtcaagtactgtgtcctactggatcttaaattctacaaggaacagcattgccacattgcaagggggtagacgcttatactccaggtatgtctcaaataggaataaattaaaatggaggctcttttcccgggtgccacccaccctaaacagttccccatgtggtggctttactctgtgcaaagcctacagacacacatcaacagaggaagatgattttcacttgcaactcagccctgagcagataaatgaagtgcttcgagctggcgagacaacccacaagattcttgaccttgaaagcagagtcccaaattcagtgttgcggtttgagagcaaccagctggctgccaattccccagtggaggaccggcgaggtgtagcctcctgcctgcaaaccaatggactgatgtttggcatcttcgatggacatggtggtcatgcatgtgcccaagcagtgagcgagaggctcttctactatgtggcagtgtccctgatgtcccaccagaccctggagcacatggagggagctatggaaagcatgaaacccttgctgcccatcctgcattggctcaagcacccaggggacagtatctacaaggatgtcacatctgtgcatcttgaccacctccgtgtctattggcaggaactgcttgatttgcacatggaaatgggactaagcattgaagaagcattaatgtactccttccagagactggattctgacatctcgctggaaatccaggcccccctggaagatgaggtgacaaggaacctgtcactccaggttgctttctctggggcaacagcttgcatggcccatgttgatggaattcacttgcacgtggcaaatgctggtgactgccgagccatccttggtgtccaagaggacaatggcatgtggtcttgtctgccccttacacgtgaccacaatgcctggaaccaggccgagctgtcccggctaaagagggagcaccctgagtcagaggacaggacgatcatcatggaggacaggctactgggcgtcctcatcccctgcagggcctttggggatgttcagctgaagtggagtaaagagttgcagcgcagcattctggagaggggcttcaataccgaggccctcaacatttaccagttcacacccccacactactacactccaccctacctgactgctgagcctgaggtcacataccacaggctgaggccccaggataagttccttgtgctggcctcagatggcctgtgggacatgctgagcaatgaggacgtggtaaggctggtggtggggcacctggctgaggcagattggcacaagacagacctggcccagagacccgccaacttggggctcatgcagagcctgctgctgcagaggaaagccagcgggctccacgaggctgaccaaaatgcagccacgcggctgatcagacatgccatcgggaacaatgagtatggggagatggaggcagagcggctggcggcgatgctgacattgccagaggacttggcgaggatgtacagggatgatatcactgtcactgtggtgtattttaactcagaatcaatcggtgcatattacaaggggggttaagaatctcccatcctattgtcaaggttaacataaatgctcttctaaaatgtttcacttactcctaaactagctatccaaaccttactattaaaagcgcaggcagatttaatttgctaaatagactaacaggaggaaaaaaacaaacagcctagctttaaaaaacagtgaaatagcagtgatttcatgtccctgtatgttctgattaagtcttatatgcagagaggacagagcataaagtctatagaattggcttgggcttgtgtagccccagtcatttgataaagatgttgttaaactgtgtcagcctgagccttcaaagggtaaatttaatcatgattctgagaataaagaacttcaggagcttcttaggtcttgccacaaaaatctgcaaatttgataattctcctgaattcacaatcatggacttgtagactatgaagagatattttatttgtttgtcttttatttaaattactaaggtctaggtttacaaagcatactacaggacccttttctatgcaatatcctaacttttttttttgtgattatgcttgtgagaaattttgtaatactacattctagttctgttttcgtttattttaaaactgaatccttaaacttgcaaacacgcctactgtaagcatgcttggaatgacttgttttggttttcagctgataggatctatgcctctggaccagctgaacttactggtgcagctttttgtgccctctactgagtcccattccagaaactttgagccatgctaggaggtaactagtctatgccttaactcctgacctttcctgcattagtaaaatttcctcctgggctgagcctttgggggttgattcacagcatttaagctttctgattatacctctcaaacattcttctgtcaattccacacaatccttctacctctgctatgctgaacccctcattcaccctgcacctgccaactgcaaaatattgtctgaaagaatctttcacatgttcctgcttcctatggctgcaggaaaggagaaaatgtgattgcatgtggtagttgtggtgatagacgtttagacaggacaggttaatttagcggattgtggacttaagattcaacctctatctggagaggtgaaaacacaaaggcttaaggacaacagtttctaaccaagtttctctgaatcctttcctgagaggtggtgggcaggagggaggagtgagacttatcagatgggacgcttgccccaagactgtgggataaaccaccattgctagtcctcaggaattagaccatatttagtataggagttggggcaaaaataaaagtgtaatttgtaatggtttctgtgggctgtagactctttgtatttacttggaaattcagttatgtggatccattttggagatgaatttcatctcatgagttgctgtggcatttaaacaacaggaaatgtgtccctaaatggaaacaaatataatcccacaaaaccaacaattttatttgcctctactacgtcaggcagaattcttcaattaagttgaactacatttgttgatcccttttctcatcttacccctttatgccacctactgaaaagaaaaacaaatagctaggtttggtttcctgttttttgtctatgtcccagctgacattcagtcaaatgttgggatacttctaatttggtggtgtttctttgtacatttttcagtgcaactgtttagtcatgtgttttcatctaagaaattatcttttgaatatttaagccttgatccttttattctgaaaccattaatattccttcttggctgggtgcagtagtttacgcctgtaatcccagcactgtgggaggccgaggcggatggatcacctgaggtcgggaattcgagaccagcctgaccaacatggagaaactccatctctactaaaaatacaaaattagccaggtgtggtggtgcatgcctgtaatcccagctactcgggaggctgaggcaggaaaatcacttgaacccgggaggcggaggttgcggtgagccaagatcgcaccattgcactccagcctgggcaacaagagtgaaactctgtctc

SEQ ID NO: 5366 - DNA, 6964 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 5367 - DNA, 1063 bp, Homo sapiens
ggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatg

SEQ ID NO: 5368 - DNA, 9463 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagtaaaattctagagtcagttgattgattgaaactatttgacaaaacagttgaaagctgagctttcagtcaagaagttggtgaaattaatgtccttaaacttttcctttaggcaaaatgtcagggaaaacttaacatgaaagtagttactcccatacgcaccagtgcagtagctccaggtgtaagaggtcacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgtgctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtagaaggaggcgataggtgcagcaaagggcagccacagtgttgattccacattataatgttgttgcctcttcttggcaaaagacaccacattgtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgaccgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggctttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacagttgcaggatccatagcaccgtcgtgcagactagcagcccaaaggtgtgtttggtttggcttatacggtgttttgctttttaaactacttgccataatttaaaagtggcaacactagacttaaaaaaaaaaaagtctgattgcccatattagattttttttttaattcttcacaaaatctgctcttcctgaaagatcaaagtgtctagaaagcccaaacatgtattcttaacatagtaggcaccagctgaaactgagtaattaaacggtcccctgaagccaagtattccctggttagtcgccaccccaccactccttcctgtctctagtgtcacacttgggctgttgattttcttactcttctcttgctttaatccttccccccggctctctggctcctgtggatatctgtgcttgtttcctggtccaggatggtgatctgactttcaaaccagcttctcaaaaggggtgacataaaatcagttttgatgtttttcctcctgaaaaatcagatgaatattttagtcactgttactcatgcacattgtgttcttatgtttacagaagtgcttaagtgaatggaagcactagacatttggatttccttcctaacgtaatttttaatgattaccccttttatacagtaatttgtggtctttagaaagcagttaaactaattgaccatctaatagttgtactatacatatgtctaaaataatagtcatggtaagtttggcatcatatcttccccaaaaaatgtttattaaaattagattattccagtttaatgctattttgtgaactgtataccctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactga

SEQ ID NO: 5369 - DNA, 7911 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaacaacattctctttataaatatttttgctccctcagattttgaaatgattttatcagttttagagaggcaagacaagtttgcattagggaagaccgaaaactaaattttgttttatttcagcctctcataagggttcccctttgaaataattgcaccttaaatttattcagatccactttggtaactgaggttcagtttggttgggtaaatctgttgtgtacatttcaacaaatacttttacatttgacattactgaggtcattctgagttttaggtcccaccccattggcccgtcacctccatcagctccacttctcaaactttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 5370 - DNA, 5685 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 5371 - DNA, 802 bp, Homo sapiens
gggtggggccggcgtcgggcggggccggcggggtcttcagggtaccgggctggttacagcagctctacccctcacgacgcagacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcagg

SEQ ID NO: 5372 - DNA, 4342 bp, Homo sapiens
gccggttggggcggcgggcgcggggcggggcagggggcggggcgctgacgtcgcggcgcggcccgcggccagcggcccggtgaggcggggaggcggcggccggtcggcccggcccagcccagcccgcagctgcggcggcgctcagagttggttcctgaccgccttctgccgcggccgggtttgtcaccaggtcctggggtctgcaccggctcggccagacctcgccccccgcttctccgccatggccctggtgcggggcgcggagccggcggcggggccttcccgctggctgcccacgcacgtccaggtgacggtgctgcgggcccgcgggctgcggggcaagagctcgggagcgggcagcaccagcgacgcgtacacggtgatccaggtgggccgcgagaagtacagtacgtcggtggtggagaagacgcacggctgccccgagtggcgtgaggagtgctccttcgagctgccgccgggggccctggatggcctgctgcgggcgcaggaggccgacgcgggcccggcgccctgggccgcgagctccgccgccgcctgcgagctggtgctcaccaccatgcaccgctcgctcatcggcgtcgacaagttcctgggccaggccacggtggcgctggacgaggtcttcggcgcaggccgcgcccagcacacgcagtggtacaagctgcactccaagccaggcaagaaggagaaggaacgcggcgagattgaagtcaccatccagttcacgcgcaacaacctgagcgccagtatgtttgacctgtccatgaaggacaagccaaggtctcccttcagcaagatcagggacaagatgaagggcaagaagaagtatgatctggaatctgcctctgccatcctcccaagcagcgccatagaggatcctgacctgggcagcctgggcaagatgggcaaagccaaaggcttcttcctccgcaacaagctgcgcaagtcgtccctgacccagtccaacacctcgctgggctcggacagcaccctgtcctcagccagcgggagcttggcctaccagggacctggcgccgaactcctcacccgctcaccaagccgtagcagctggctgtccactgaagggggcagggactctgcacagtcccccaagctgttcacccataagaggacctacagcgatgaggccaaccagatgcgagtggctcctcctcgggcccttctggaccttcagggccacctggatgctgcctcccgctcttcgctctgtgtcaatgggagccacatttacaatgaggagccccagggccctgtgcggcaccgcagctccatctcgggctcgcttccatcctctggctccttgcaagctgtctcttcccggttctccgaggaggggcctcgttccacagatgacacctggcccagaggcagtcgtagcaacagcagctcagaggcagtgcttggacaggaggagctgagtgctcaggctaaagtcctggcccctggggccagccaccctggagaggaggagggggcccggctaccagagggcaagccagtccaggttgccacacccatagtggcctcctctgaggctgtggcagagaaggagggagcccggaaggaggaacgcaagccccggatgggtctcttccaccaccaccaccaaggcctaagtcggagcgagttgggtcgccgaagctctctgggggaaaaggggggtcccatcctgggggcctccccacatcactcatccagtggggaggaaaaggccaagagtagctggtttggcttgagagaagccaaggacccgactcagaaacccagtccccaccccgtgaagcccctcagtgccgcccctgtggagggcagccccgacaggaagcagtcccgctccagtctgagcatagccctgagcagtgggctggagaagctcaaaacagtcacatctgggagcattcagcctgtgacccaggccccccaggctggccagatggtggacaccaaaaggctgaaggactcagctgtgctggaccagtcggccaagtactaccacctgacccacgatgagctcatcagcctgctcctgcagcgggagcgggagctgagccagcgggacgagcatgtgcaggagctggagagctacatcgaccggctgctggtgcggatcatggagacctcacccacgctgctgcagatccccccgggcccccccaaatagccttcctcaccctacccccaggagggttggcatggacctattgctgcctgccctctctcctcctgaactctctcatctgcagtggggcatcgtctgtcttgccttgtcactccttgctcctctccctcctgcctcaactggggctgctggaagggggccctctggattccctttggaggcatcaggttctgtgcacaacttgtgtgtctttgggagccctgggtctttcccacctgcctgttttcatatccctcagctttgggggccccagggaattggaactcttcccccaagacagagcaggggtgaactgtagcttgatgcagtaatctgggacaagactggttgctagcacatactttattatcccccaaggatggtcagccatttcttcccacagccaaagccccatccccttcatttccctccagtccctggaggggcttctagtattactgggacaatgaccacgctgcctgtttgtctgtgagttacgggcaaccagcctcttcagcctcacacccattcccctgagagcaagaagcctgtgtggtctgggccagtctctgccatgtcctgagtctgcttcagtctggagctgtttgtggggcgagtgccatgtggacagtggtggatgatgtgtgtgcttcaggctgctccctgacccctctgacctttccacgagtgtcacatgggaatgtgtggggcgcaggggcgggtgcggagagagcacctttttgcttttcgagctcttgaccacctccaatgtgtaggtccctccaggctggggcttgggactgcttatgatttggggatcaagcctccatgtctattcttgttgcctgtccagatgccaaaactctgtgttgctgcagggtttgaacttttggaaaccaattaaaatgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccctcccctaaagttaatctcttggtctggccaagttgctgctccctcaaccttcctgctgtcttcccctccctcaaccccaataggaggatcccaggataaacactgctgggcaggcgggcaggcaggcctggggctgccctgctcactctcattgtctggcctcaggacttagccatactagaccagtcagcttgcctggaagagggaggtcccactatgcctttgggagacacctatacttaggaaaaagcctttgttgtcctcccatccatccattaagctgctatctcagcctgtcccttctgccccaggggcttgcctggcttggctgcagtgcactttgaaatgaagtatctgtcctttggcccagcccctggtttgcttgtagaaaacatggtaggcttccccaaggcatctgcagggaactttggcagcttggggcaccctgaattagcaaaaatggggggtgatgaggtgctgaagaaggatacttaacagcttagtgaggaggcaagagctcctctgggaccaccacttcttcaggagagggcctgtgggcttgcttttggaaggcctcaggcagacacgtgccctctgggtgatgtctgtctgctgccaggatggagcagaggagcgccacacatggaggaaagcccctgtaacgttacctaccttaaactccactcatcaaatctgagaaaagtatccactggtccccagggtttcagtcatgcttttgggggtcattgggtattagagaagtaagtatcttttctgagagagggggagtcaccccccctactggggattcctctgggctttattcactcccagccctggccctgacctttgtgggcctccctaatgcccagggcatggatggcttcagaggagtttttgaatcgaagcccagggtccttgttgatgtttcttctcctagccacacttggaggaaagttgcaggtgggttgggcagggagcaggcatggttctgctttgctgtttgtcttcctagttaaggctctttataaagagcttgttcttcatgttttaagcactttatgaagaataaaacattcatgtactgca

SEQ ID NO: 5373 - DNA, 1624 bp, Homo sapiens
cattcaaccgccgctctgcgcggcgccggctccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctccgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtac

SEQ ID NO: 5374 - DNA, 3391 bp, Homo sapiens
gggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgaggtaggagatgccacctcactgccggggtgtggagagggtgcctcaccggggaaggcaaggcgagggccagatgggaaggcaaatgcttccaggaagctttgccttccacagccctggatgaagacctctggtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaaccaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaaccacc

SEQ ID NO: 5375 - DNA, 3515 bp, Homo sapiens
cgcgcgctccccgccccctctctccggggcggcggcggcggcgcaggggaaggggcgggcaggggccgccgccggtttctcctcccaccgcctcgcgccagcccagccgagccgagccgagccgagcgggcgccgcgccgggctcccgccgcagccgcgcttcccggcacccagcgagcgagtgggcaggcgggcgggcgaggcagccgcgggggccgggcccggcgtcctcctcgccgcccgcagcgtccccgggcgggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaaccaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaacca

SEQ ID NO: 5376 - DNA, 1093 bp, Homo sapiens
ttgcactttcctttcactttctcaggacgccaaacccgacacctggggccagaactacacttcccaccaagcagcgaggcaggaggaagaagggggcactggggggctgaaaagcaaacccagaagaaagcgaaaacattacctgctgaccagcagaggtgagagagcgagacagttctgttctaggtggcaagaaccatgcacttctccagctcagccagggcagcagatgagaactttgactatttgttcaagattatcctcattggggattccaatgtggggaagacgtgtgtggtgcagcatttcaagtctggagtctacactgagacacagcagaacacgattggagtggactttaccgtgcgttcccttgatattgacggcaaaaaagtgaagaacagttcggccagtattatcacctttgccagtattcagatccacgggcagactcaaaagatgagcccccaaatctggaccaagagttcccattacctgtgggaacccctgatttggactctccttcctgtccttctccagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggaaataaatgtgacctctgggaaaagcggcacgtcctgttcgaggatgcctgcacactggctgagaagtacggcctcctggccgttttggagacatctgccaaggagtcaaagaacatagaagaagtcttcgtgctcatggccaaggagctgatcgcgcgcaacagcctgcacctatatggggagagtgccctgaacggcctccccctggactccagccccgttcttatggcccagggtccaagtgaaaagacccactgcacttgctaagatgtttgcaaagccagttgcacccaccaaagaggccgcctctgaaaccaaaggtagccaggataccgtagtgttgccccagtggcgctttagaccccag

SEQ ID NO: 5377 - DNA, 822 bp, Homo sapiens
ctggatccccagttcctggtgctgaattccatcctttcttcctagttctgttctaggtggcaagaaccatgcacttctccagctcagccagggcagcagatgagaactttgactatttgttcaagattatcctcattggggattccaatgtggggaagacgtgtgtggtgcagcatttcaagtctggagtctacactgagacacagcagaacacgattggagtggactttaccgtgcgttcccttgatattgacggcaaaaaagtgaagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggaaataaatgtgacctctgggaaaagcggcacgtcctgttcgaggatgcctgcacactggctgagaagtacggcctcctggccgttttggagacatctgccaaggagtcaaagaacatagaagaagtcttcgtgctcatggccaaggagctgatcgcgcgcaacagcctgcacctatatggggagagtgccctgaacggcctccccctggactccagccccgttcttatggcccagggtccaagtgaaaagacccactgcacttgctaagatgtttgcaaagccagttgcacccaccaaagaggccgcctctgaaaccaaaggtagccaggataccgtagtgttgccccagtggcgctttagaccccag

SEQ ID NO: 5378 - DNA, 645 bp, Homo sapiens
ttgcactttcctttcactttctcaggacgccaaacccgacacctggggccagaactacacttcccaccaagcagcgaggcaggaggaagaagggggcactggggggctgaaaagcaaacccagaagaaagcgaaaacattacctgctgaccagcagaggtgagagagcgagacagttctgttctaggtggcaagaaccatgcacttctccagctcagccagggcagcagatgagaactttgactatttgttcaagattatcctcattggggattccaatgtggggaagacgtgtgtggtgcagcatttcaagtctggagtctacactgagacacagcagaacacgattggagtggactttaccgtgcgttcccttgatattgacggcaaaaaagtgaagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggaaataaatgtgacctctgggaaaagcggcacgtcctgttcgaggatgcctgcacactggct

SEQ ID NO: 5379 - DNA, 952 bp, Homo sapiens
ttgcactttcctttcactttctcaggacgccaaacccgacacctggggccagaactacacttcccaccaagcagcgaggcaggaggaagaagggggcactggggggctgaaaagcaaacccagaagaaagcgaaaacattacctgctgaccagcagaggtgagagagcgagacagttctgttctaggtggcaagaaccatgcacttctccagctcagccagggcagcagatgagaactttgactatttgttcaagattatcctcattggggattccaatgtggggaagacgtgtgtggtgcagcatttcaagtctggagtctacactgagacacagcagaacacgattggagtggactttaccgtgcgttcccttgatattgacggcaaaaaagtgaagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggaaataaatgtgacctctgggaaaagcggcacgtcctgttcgaggatgcctgcacactggctgagaagtacggcctcctggccgttttggagacatctgccaaggagtcaaagaacatagaagaagtcttcgtgctcatggccaaggagctgatcgcgcgcaacagcctgcacctatatggggagagtgccctgaacggcctccccctggactccagccccgttcttatggcccagggtccaagtgaaaagacccactgcacttgctaagatgtttgcaaagccagttgcacccaccaaagaggccgcctctgaaaccaaaggtagccaggataccgtagtgttgccccagtggcgctttagaccccag

SEQ ID NO: 5380 - DNA, 1514 bp, Homo sapiens
gtgggctccgtgctctgcacccagctccttcccgggcgcgcacacgcgcttcctctcttgagctcccgggcgtccggaggcgaaggtcccggagcgttcacgagaatccgggtcccggcgagtccggggtccgctcctccagctgcgcccagggcgcacgagccggccagcctcggggagagggcgcgggggcgctgggggttcttacgggaagatgaggaagcccgacagcaagatcgtgctcctgggggacatgaacgtggggaagacgtcgctgctgcagcggtatatggagcggcgcttcccggacacggtcagcacggtgggcggcgccttctacctgaagcagtggcgctcctacaacatctccatctgggacaccgcagggcgggagcagttccacggcctgggctccatgtactgccggggggcggccgccatcatcctcacctatgatgtgaatcaccggcagagcctggtggagctggaggaccggttcctgggcctgacagacacagccagcaaagactgcctctttgccatcgtggggaacaaagtggacctcactgaggagggggccttggcgggccaggagaaggaagagtgcagtcccaatatggacgctggggaccgtgtctccccaagggcacctaagcaggtgcagctggaggatgcggtggccctttataaaaagatcctcaagtacaagatgctggatgagcaggatgtgccggccgctgagcaaatgtgctttgagaccagcgccaagaccggctacaatgtggacctcctgtttgagaccctctttgacctggtggtgccaatgatcttacagcagagagctgagaggccgtcacacacagtggatatatccagtcataagccacccaagaggaccagatctgggtgttgtgcctgactttcgagggcctcctggactcagactgtgcatgttgggaaggggtctgaccaggcaagctgtgatctgaaaggagcaaggaacagcaaggaattattttccagaatgacacccgcagcagaatgttggagtggaaatgatggctggctatgaagaggaggtcaacgtgtgtggtctcctcagtctctgtcagaggggtggggaggtgggaaacaggaatcctctgcaaagcccaatctgcagagtcgagacccctggtgctctctgccccgctgcctggcactggtcctttgcagccagccaccaacggcccccttgcccttgcagaggcagaagcctgcgtctgcacctgcacctctgaccgtttcagcaccctgggttgttaccacgtcctacaactctgacatttcttgttctcaagcgtttctcttcactgtgagttgtctttggtcctcccacttggtacttgtatcttgatgctttataatcctgactctcgacgtgttcatttatacaaaatcaggaataactttgtttttatactgattgcagcaatgttggctacatgtattattaaagaggatttttggaacaa

SEQ ID NO: 5381 - DNA, 7003 bp, Homo sapiens
actcgcagtcctgacgggcaggggctgcggaccgcccggccttggacccatccggagccacaggttggaggagataagtagctgtccccgtgctcatcgccctgtggagcagatcctgtctccttgctgacggtggagcccgggagttccagggcttgggaaggggaaggaaacctctctgaaatctgacacctgctctcccggcaaggaaacttcgcaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggcataccatattttgaaacaagtgcagcaactggacagaatgtggagaaagctgtagaaacccttttggacttaatcatgaagcgaatggaacagtgtgtggagaagacacaaatccctgatactgtcaatggtggaaattctggaaacttggatggggaaaagccaccagagaagaaatgtatctgctagactctacatagaaactgaacatcaagaaccccaccaaaatattacttttaaaaacaatgacaaaccacacaattgttgttgagtaaaccacgcacaatggcatgtctttctttttctgccagaaaatctattttaagaaaccagaatagtcaacagtgttcaaaagaattgactagttatccctgaggccctttcaaacatgatcaaagatttcccaatgtgatctcatcatcatggatactcaatttgttttttcttatagagaaaatgagtatataagacaatatacaagaagaaatatcagtgagttttaaatcagaacaagttacctgtcacattgaagaaaagggtaggcactaaagggagaacacagaaagaagaatttctaaaatattggatttacttcttatattgagtcagatgcatacttttagatttgcattggggaaaatgtactagctaaaaatggatacacaatgaagaattctatttggctaattaagaatgatatactatgtacacccaataagctgtactagaatgaataaattactgataaggttacaaataggtaaatgtcacacttctgttaaaatgcaggaggtagtgtcataatgccgtctttatattcttaataaatagcactttgacaagaacaggactgtaaatgatgaagtacaagacaaataccctgggaaaaaaaatgaaagtatgagaaattggcatttctacagctgaaattcaatgtatctgttagagatgtctggaagggttacttagccaaattttactcaagccaattaggagctgatattatcagttggaattaagagaactccagaggtttccatttcaaacaaaattttagaaattggtttggtgttcagcttcacatttcattttttcttagcacatgttgataaaatagtcacaaggagaaattaccagttacggtttattaaatctcttttaaaatgcagtcaaggaaaactagccttgaattttttttagataaaataagatggtgatatgaaacaaaaagtggcaattattgcaggtttccttttagtttacaaaagtactggaaactaaatcatatttcttccctccaaatttcacccattcctgactttgaatcaattgcagaaatgcaggtgtgttactttgttgatcaataactttggaacaattatggatcaattctatggtcactctgaattttcatgtcattaatcacataaaaattgataatacctcattctgtattacaatatgattttattttgccaaaggcaagacacctatagttgagctgtattttgggggattgggtgaggaaggacttctgatcttatctcaacaaaaaactggccagtatttttgttaatgtaaagcttccttttctttctaaaaaatagtaacaaaattatttttcattggcctattctgttcttgtgtctaaactaacattacattaatttttaatcttagtttctgataaacacaagccattcctatcaaaatattatttatttcagtcaattttaccaaataacaaagacaatatattttcgtttttttttattatgagcatatgattttttgacaggctgtttcctcgtcgtatagattttttccaatcaaacctactttttccatactctgtgcatattttttgtgaagttatacacattgaagaccctaaaaatcccagtccatcattcagcttacctctgcgaacttctatctggtattgaatcagtttcagaaacacagacagatccaaggaaatgtctctttataatgttcttaggatggactagacccataaatgtgccatgaatcaaaatattaataatttgaaagctttcatgctgttagcccctgatgaaattctcagcattaactggccagctcctctgatttctgcagcatcgcaacaggttcgaagatgggttgtggctgggtattccctcccatggtgtttcctctgggatgctcttcattatctcaatgcctgtgccatgaagatagaaaactgtaagctaacatttaagatgtttcttctggaaggaaagtgagcaggaacaagttatattgccactgctgtggcaaattttggtgaacttttggggtcattatatcaattttttctttggattcaaattgtaatgtcccctgcatttccttaatagggaatgtgaaacctttataaaactctaaaagtattctgttttgatatgtctttttgtttctattcattttcagttatatgattgatttacttatgccaagattctgtcactgtcagttatttaatgagtgttttttcagggtctgttttaagatcattatttgatagctgtagcatgaagcagaggttgatgatgcccataattgcaagactattcctgtaaaaataacaattattgggtaataacttcaagaggaatgagaagtgacaaaattgatttaaaatattgttctacttataaataaatgcttgatataaaaaattttctccataaagtttgacatctgaccccagattctatgtaatcattattagaaattccttctctcattatttcaggattagtagttctgtgtaattcattttacaatttcaaattgttctggtgccataaagtatacagactactttaaagatttccaaatcccctaatttaccccacaacagcatgtaattttagccaagatatgtcctgttactaagtatctcccaatgctttagtaaaacgtatttaggagaaatgttgaaaatgtacatgaagctcctttctgatatagaaaccatttctggagtatttacactggtttgatgtttacattgctctaactcggtgcctcagatacctctgtgaccaaatttgtctccaaccacatagctcatttcctataatgttatatcataggaagccctcacagagacactaacacagctaaagatcttctgatattatcagcaagggatgcaaggactttattggaatctggagagtttaactgccttctcttggtctcctcacttacttcttatgaagttggcattacctgagactcttagctgtgattaggtacaagcttaccttttagggtagaaaaagaaagatcatttgaaaaatgtatctaaaataatccagagaacataatgtttgtcttggtctgataatgataagaagtcaaggattggcagagaaaatactaaacgccaagagttgagcctgtgggtctctccataagagttttaaaactcttgccagttaccactttatccaatttgctatcattttcgtattatcagctatcgccctgtaaaatattcaaaactagctatttctaaagtaaacattttatctgttacttttaaccagataggtgtctttgtcatccttctactataaattgttctttgccaacctgtacaggtagatgaaccaggcgagagttttaatcagccttttcttgtcccctttgtaagaaagagatgcttgccatagagaaggacatgagtacattaaaaataatttaatagccacaatatgatgttctttaagctgcaaattgagtacactgggaatcaacaaatttgatgaagcctgtctgtctcttcaccagtggagtgagtgcagcagttagaaagagaagcaatattgtgcaactggtgcagtggtgagttaatcatagtgtataaccttgtgttcatgaaacaggttgttcattgttctgcatctctcttcatttaaaaaggatacacaattctttcctcattgcatattacaccaaacgtttgagggaaaaatcctcattcgtaaaggattttggatgtataatctaaaactcaacaataaagaaataatattccaagtctctggtttcctaagatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgccagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaaacaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgattttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctcaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaatta

SEQ ID NO: 5382 - DNA, 1830 bp, Homo sapiens
acagttcccgccgccgaacttagcccgcgggtggggcggcccgggagccagcggggcacgtgagcgatggagaccatctggatctaccagttccgcctcatcgtgatcggggactccaccgtgggcaagtcctgcctcctgcaccgcttcacccagggccgcttccccgggctgcgctcccccgcctgcgaccccaccgtcggcgtggacttcttctcccgcctgctggagatcgagccgggcaagaggatcaagctacagctctgggacacggcgggacaggagcggttcagatcaataacccgatcttattaccgcaactcagttggtggatttttagtatttgacattactaaccgacgatcttttgaacatgtgaaagattggctagaagaagcaaaaatgtatgtacagccatttcggattgtatttctgctagtgggacataaatgtgatttagcttcacaacgtcaagttacaagggaagaagctgaaaaactgtcagcagactgtggaatgaagtatatagaaacctcagcaaaggatgctacaaatgttgaagaatccttcacaatcttgacgagagacatatatgaacttattaaaaagggagaaatttgtattcaggatggctgggaaggggttaaaagtggttttgttccaaatactgtgcattcttctgaggaagcagtaaagcccaggaaagaatgcttctgctgacttcaaacatgctgaagaactaacaggaacagattgggtgtcagttcaggataaataccaacattaacagcagaatgatgcaatgaaagaatttaaaaaggttacaaacccacaccaatactattttataaggtatttgattcagagcatgatgcttacttgttacactactagattgggtattttgctaaattaccaagcaaagcagacaatctttttcttgaaattacctccattcttactttgttagcatacgctgaccttagtgtccagatatgtcactattactcatttttcttgacagttcaaatggatttttgtgcatatatagtcaattgaaaagattttatcaggaattacattctcttgagttaattaatattgaatagcaaaatgcatttaaatatgcactgttcacctgcagagtaaacaatctcagaagtatcgactaggacgtaaatagcagttccttatataaagtaccaggttttttccccattctctggaaatgtttgtcctcccttaattttgcctcaacacaagaaaataagttttatgtccatttttgttccctaatttattgcttctaaaaatgcattatgttttacaaagatatctaaggatccaagcaaactactttaagcaaatatttgtaaaattaaaaacggaggaccgctcaccaaatgtttgaaatgttgctttttttttttgagacagggtcttgttttgtcacccaggctggagtgcagtggggcaatcttggctccctgcaacctctgcttcctgggttcaggtgattgtcagtaccttacctcagcctcctgagtagctggaactgcagatgtgcgccaccatgcccggctaatttttgtattataagtagacacagggtttcataatgttccccaggctggtctccaactcctcgcctcaagcaattcgcccccctcggcctccaaagtgctggaattataggcatgagctgccgtgcctggactatcagcagcacatgttttgctgttacggtgtactgttcgtatttagacaagaagaacaaaatttatttatgtattgacattttcaaagaaagtaaatgcaatttactttgaa

SEQ ID NO: 5383 - DNA, 4272 bp, Homo sapiens
ccttcctccgccttctgggcggagcccgcgcgggatccgggtggctgcaggctgctggcttctgcggctgcggggtcggggtcgcggccagggccaagccgcagcgagttcacaggcggaacccctgcaggcggcgccccctacgcgaggtcacccctgggaaggagcgcagcccacccggcccctccgcatccgagcaggacgcccgtctcctctccctgaggatttcaggtctccctgtcccaggaggcttgtgccaagatggcatcagctggagacacccaggcaggcccacgggatgcagcagatcagaacttcgactatatgttcaaactgctactgataggcaacagcagtgtgggcaagacttccttcctgttccgatacgcggacgactccttcactcccgccttcgtcagtactgtgggcatcgatttcaaggtcaagaccgtctaccgccatgacaagaggatcaagctgcagatctgggacacagcgggccaggagcgctaccgcaccatcaccacggcctactaccggggagccatgggcttcctgctcatgtatgacatcgccaatcaggaatcctttgccgctgtgcaggactgggccacgcaaatcaagacctactcctgggacaacgcccaggtcatcctggtggggaacaagtgtgacctggaggacgaacgtgttgtgcctgctgaggatggccggaggctcgccgacgaccttggtttcgagttctttgaagccagtgccaaggagaacatcaatgtgaagcaggtcttcgagcgcctggtggatgtcatctgcgagaagatgaacgagtccctggaacccagctccagctcaggcagcaacgggaaaggcccggccgtgggggatgctccagccccccagcccagcagctgcagctgctagagatggcccccaaccccccacccacccctctcctgcctcggcagggactgtgatcgaggcgtgagccacagtggttatctccaagctcagggcaatcccttccctcctgtcaactgctccccgactcctgcatggctcattccttcacaatgtcgccgtggctgccaggttcctcaggcagccccggtgggaggctgcggaccatggggactcagctctgcatggcaggcagaggcccagggacactgacgtgcatgagcttgctgctttccagggtgtgttgagggtggccatgggtgacacgtcccactctttctgatggaggggcatccgtggtgccttctagcttagaaccattttccaggtctcttctgggttgggcaggactgatattcccaagctggtggaagatggttcatcttcctcgcacagtgtgggttcttggagttcatccagggaaggcggcgcctctttctcaggtcctgcaggctggtctctgagcctgcccccacgaactttctggattccaaggtgggatggtgatccctttgacccctgcagaccctctacttgcgaaaagcagcattgaagcagccttttcccattgtagaagggacagggagtcagatcccctcaaccccccggcttcagggaccccagaagtgccttccaagcttcccccaagatccacatcacccacgaccctgccactgtttttgctgtgttcaccacatctctgatcctgaagtgaattctggaactatggaccacattagactgggcagagattcgcccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttctttttttttttttttctttttgagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatgggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactctaggggcgcagcaccttttctttgctcccaaacaccaaccaacaccccttcacaggaccagcactgttaggatggctaagtggatgttttatgttcccacgtccctgactctgtttcagaggttgtgtctgctctcccagcccctgaagccaaaatgacttcctgcagctttcatgagctcagcctcttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaagcgattctcctgcctcagcctcccgagtagctggcattacaggcacctgccaccacacccggctaaattttgtatttttagtagagaaggggtttcaccatgttggtgaggcttgtctcaaactgacttcaagtgatccacttgcttcggcctcccaaagtgctgggattacaggcgtgagccatcacgcccagccgagggtatcttttataccaacaaattagatgactgaggtgtaatggacaaatcctatgcacaaagtgagggtatctgaatatgtgggcgggagtcaaaaatttttagctactttaacactaaagtcaaactaaagtagcttcaaaaagacttctcaagatgcagtatggcctgctgaggtttttttgttttttttttttttaagacagagagtcgctcgtcgcccaggccgcagtgcagtagcatgatctcagctcactgcaacctccacctcccgggttcaagcgattctcctgtctcagcctcctaagtagctgggactacaggcacctgccaccacgcccatctaagttttgcatttttagtagcgacggtttcaccttgttggccaggctggttttgttggccaattgtctctaaactgctgtcaaaaaaaggaatggatcagattgtcttgaatagggcagagctaacctgtaatcacctgtgtgatgagaaacagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctctccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaaacttaaatccgtcgtgcccaaatatagttgtgcttttatttcc

SEQ ID NO: 5384 - DNA, 1345 bp, Homo sapiens
ccaaacatggatcctcatgattttattttctagattggctgataggctgaataatctcctgtagggtaagaagtgtcaactgtatcaagcacatggaggtggactggctacaggagaaagtgtgacgtgggtgaaggagttcttattgagccatgggaggaagaaatagtacagaagagcaaagaataataatgagtcagctagacagaagacaggagtcatcagatttgtaccctagttactcgacccatcaactgactgtggtttttgggaacaggcccggcaccacctctgcgcacaaccccgcgggcctggctcaggcgggagtgcggggccagcaccatgagcgccccgggcagccccgaccaggcctatgacttcctgctcaagttcctgctggtgggcgacagggacgtaggcaagagtgagatcctggagagcctgcaggatggtgcagctgagtccccgtacagccatctcggggggatcgactacaagacgaccaccatcctgctggacggccagcgggtgaagctgaagctctgggatacgtcggggcagggaagattttgtaccatattccgctcctactctcgtggtgcacaaggagtgatcctggtctacgacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggtgtgaccttctttgaggtcagccctctgtgcaatttcaacatcatagagtctttcacggagctggccaggatagtgctgctgcggcacaggatgaattggctcgggaggccgagcaaggtactgagcttgcaagacctctgctgccgcaccatcgtgtcctgcacacctgtgcatctggtggacaagctcccgctccccagtaccttaagaagccacctcaagtccttctccatggctaagggcctgaatgccaggatgatgcgaggcctctcctactccctcaccaccagctccactcacaagagcagcctctgcaaagtggagatcgtctgcccaccccagagcccacccaaaaactgcaccagaaacagctgcaaaatttcttaaggaaggcaccaaaaggaaacaagctggaatcgctccaggaaaaactctggttacacctggaagatggaagtcgcattgtagattcaagaaattagttttcagtttctcacgggaaccatgctgcttgggaatgtgtgtgatgccttctgtcaataaaaacacattacac

SEQ ID NO: 5385 - DNA, 3126 bp, Homo sapiens
atactctcaacaggttttctcatttgctccttgggacagctcggtaaggatgatacagtcagttctatctcacagataatcaagctcaggctttcagagcctaagtcaccttcccaggtaagtggcaggattggaatgaggtttcatccctcaccctccctaaaggaccctgagcacccccttttagaagatgggcttccagggcttgagaaatgtcagattccactcccctgctattgtggccccatgggtcccccactccacaacccctctgggtgatgaggaagacagaagtgaaatcctgcactttatgccaagagactgggtgtgggaccgtatgagttggctgatcccttaagtggtgagtgggctcaggcagaagcttaggtgttggccttgggacaggtgagctgaagagaaggaaagtaacctgcactgaactactttaggcaaatgcactctatatttcatctcctttatcctaacggctgttcaaggtaccgatgattatgatcattattccaatcagggtgctgtctttaagggagtttgtgtaaatcagggagagaactttattatctccttattgtcagctaaatctggaattaatctaaaggttttttttttctctatttgccctgaagcccacagagaaatagaaatgtttttcttatcctttattcacgtttgttctgtattgatgagtatttagaatgtttctcattttttcctttttaaaaagatttcagcaatgctatttcaaataaccacttacctggctattttggacatgtgaaaattttttcctccattacatttgtaaacatctatcccttggggcttgatttcaataatttaaactcccttatatgtgtatgagcattctcatttctttaaccatctttgtacctgttgtagttacaatatttaagtgtatttataactgataagtgtgtttccatttccttgatgtatttggtccctcatcctgcccccatacacagacacacacagagcctttttcttttgcatctttttcttttgcaaattaaaaaaaaattctttttcggtttttttctacatttaaattttgtcagatgataggtgataaaaggatatttagatggtttcattagcattctttaatgtattagtgagctagaatgcattttcttgtgattactggccatttgcgtttcttcacctgtgaaccatatacatattttttcagttttgttattttgttataggagctgtacatgtgttaaacctaaaacccttcactgatggatgcatgcattatttcaacacatctttgttgggtgaatattatttatgagacactctagcaaaatccatgtcctagatatctcttctgagatcttggctcttatatttatgggagatgtccccctgcagcaagaaaagtattagtgcccatgtaaacatgcgtggcttgtcaaggatcacatgcacagacagttcacacttactcctaaacccggcatggccacagagtagaaagggtgtgtagtgcgttatatgaggagagcactggctcaggattgtgatttctgtgatctctatattaatggcaatgttttaaaaaattacataacatttctgagtttgccttttctcatttgtaaaatggaaacaattatagctaccaaagacaactgttctgaaagcaaaagaacaaaatattttaagcgtcatacacagcatagggtacgtacagtactcaacacatcttagtccctttcctatcccatacccgtccttcctttaaaggagattcctttgacataatccaaaaggcatggttccataacgatcacatgaaagttttaagggaaatgtataggtttccatgatgaattaactgctgtgtcactactctgtgctgggtaagaaaaaggaaaacaatcgctgaatcagtttcctagggtttgtaaaagaaatccatcaaagccaccacctcatttcgctttatttcacagacttccccatctcattttttatgttctatgctaatttctcaagaagaacaggcccggcaccacctctgcgcacaaccccgcgggcctggctcaggcgggagtgcggggccagcaccatgagcgccccgggcagccccgaccaggcctatgacttcctgctcaagttcctgctggtgggcgacagggacgtaggcaagagtgagatcctggagagcctgcaggatggtgcagctgagtccccgtacagccatctcggggggatcgactacaagacgaccaccatcctgctggacggccagcgggtgaagctgaagctctgggatacgtcggggcagggaagattttgtaccatattccgctcctactctcgtggtgcacaaggagtgatcctggtctacgacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggtgtgaccttctttgaggtcagccctctgtgcaatttcaacatcatagagtctttcacggagctggccaggatagtgctgctgcggcacaggatgaattggctcgggaggccgagcaaggtactgagcttgcaagacctctgctgccgcaccatcgtgtcctgcacacctgtgcatctggtggacaagctcccgctccccagtaccttaagaagccacctcaagtccttctccatggctaagggcctgaatgccaggatgatgcgaggcctctcctactccctcaccaccagctccactcacaagagcagcctctgcaaagtggagatcgtctgcccaccccagagcccacccaaaaactgcaccagaaacagctgcaaaatttcttaaggaaggcaccaaaaggaaacaagctggaatcgctccaggaaaaactctggttacacctggaagatggaagtcgcattgtagattcaagaaattagttttcagtttctcacgggaaccatgctgcttgggaatgtgtgtgatgccttctgtcaataaaaacacattacacagtt

SEQ ID NO: 5386 - DNA, 3859 bp, Homo sapiens
agcgctgggcggcggggcggggccggaggcgagcaaggactcggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattggagtgattagtataaattcaatggaatttgagaagcaatggcagcgggataatttagagtcactgatattacgagaggggtctttttgtaaacctccttttcaatgtcaaagcgccaatttataaaacgctgcagatgtagaggttatgtgcaactgatctgtccagtttgtgtatgaaatggatttgataaagtttttgctagttatttactacattttgggattaataagtgatttatatgcatatttttctgtaaatctacagttttttgtacaagatattctacaagttatgaagctaagggaagaaaatgccaaagatacctctagttatgttgaacacagccagcacagtttcgacatgtcaaggaagagctgtttcagtaaagaatgaagtgaaaacacttatttaggaaaatgtttctcaacaataaaatgtatagttgtttctctcttggtagagttggcgaccggttctttcgaattttgtatttatttatttatttatttttgagacagagtttcgctcttgttgcccagggtggagtacaatggcacgatctgggctcaccacaacctccgcctcccgggttcaagcgattctcctgcctcagcctcccgagtagctgggattacagaggtgcaccaccacgcccggctaatttttgtatttttagtagagatggggtttcaccatgttggtcaggctggtgttgaactcctaacctcaggtgatccacccaccttggcctcccaaagtgctgggattacaggcgtgagccactgcgcccggccagattttgtgtatttcttatagccctttacttcactgcgccactgcctggtgtagacatcacatatcggagctaatacacgacactggcaacaaggctgaatccttgaactgttgtcgcctgttgagaaaggattccttttccggaacagaagtgcagaggaggagagagcggagagttaaaagctggcacccaggcatgtgcctgtctgagaaatcagagccgtgctcctgagcctcggtgaggagctccgaggggctgtcaggaattccgcatgaagatgtagcccctgaccccgactgcctcagagcagggctgaccgcaaagacctccagggccgctctcttccctggtcacactgttgaacgtttctctgtggctgggggtcgcaaatgagggactaaaccaaaaaaacgaagcgagaaaatacccagatgttcctagttcctgctgatgatctgtagattcttagaaacttaagggacccagctgggtgtgatggctcacacctgtaatcccagcacttcaggaggccgaggcagccggatcagaggtcaggagttcaagaccagtctggccaacgtgatgaaaccccgtctctaataaaattacaaaaattggcttggcatggcagcgcacacctgtaatcccagctactcaggaggctgaagcaggagaatcacttgaacctgggaggcaggggttgcagtgagccgagatcgtaccactgcaccccagcctgggcgacaagtgaaactccatctaaaaaaaaaaaaaaaaaagaaatttaagggaccctagaatcaggggcaaagcctgtattcagagatggtggaaccgaggcccagacaggagagaggagcactggtccctgcgggtggacccaggcttgggggtgtctggccacctgggcacggcagccacggggacaaagtccacggggaggcaggggtgtggtctgtgggcagaaggtgaaccctgaggggacagtgtctggagagggtggccagcctcgtgcaggcacgctgcaaagacctgtgcacccttctctctgctgtgccacaggtggggtgagaacgacagggccgacctcccagctgcaaacacaaggacactgagatgcacagaaaggagagtccacgttgaagaaacccacgttgaggggcctcttctccctccgttcccagctcgctgatggtgaagggtaaggaaatggatcctcccattgcaacattaaaccaggccaaacctgtatttttctcttccttcctttttcttgttttgtaattgatgtctcctcgggactactgataatgtcctagaaagaataaaataaagtttcccaaggctttgtgactcagagctctttggaggtgttcaccgaatgcacgggccgcccggaggccttggccctccagggaaacaccaccagaagtccccagaagcggaacatgtagcaaggaggctccccgagatctcccagagggagcacagccctgccaagttattggttttggacttccggcttccagagctacgagaaaataaatatttgttatttaagtcaccaggtttgtggcgattgttacggcagcctcaggaaactcctacaaggaagtgagttacgctcacggcagaaagtgctacagcaaaccaaggcagaacaaaaacagacgaaacctaatacagaccggactaagtagaagactgtgtgtttgggtggtgaatatacaaaaaacataaatataaattaaacctta

SEQ ID NO: 5387 - DNA, 1758 bp, Homo sapiens
gggcggcggggcggggccggaggcgagcaaggactcggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattggagtgattagtataaattcaatggaatttgagaagcaatggcagcgggataatttagagtcactgatattacgagaggggtctttttgtaaacctccttttcaatgtcaaagcgccaatttataaaacgctgcagatgtagaggttatgtgcaactgatctgtccagtttgtgtatgaaatggatttgataaagtttttgctagttatttactacattttgggattaataagtgatttatatgcatatttttctgtaaatctacagttttttgtacaagatattctacaagttatgaagctaagggaagaaaatgccaaagatacctctagttatgttgaacacagccagcacagtttcgacatgtcaaggaagagctgtttcagtaaagaatgaagtgaaaacacttatttaggaaaatgtttctcaacaataaaatgtatagttgtttctctcttggt

SEQ ID NO: 5388 - DNA, 1161 bp, Homo sapiens
gggcggcggggcggggccggaggcgagcaaggactcggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttt

SEQ ID NO: 5389 - DNA, 2699 bp, Homo sapiens
cgggaagcggcggggcggcggcgaggctgaggtgcgcccgggcgcgggcggggcggggccggcgctgggcttcgggcgcgcccactcggccgccgtggggcggacgcaacgggcgcaggtgcggggcgcgggctctctcacgccgcggcctcacccggcggtgcttcggcaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggatgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtcccca

SEQ ID NO: 5390 - DNA, 2717 bp, Homo sapiens
cgcccggggccaccccgccgctccctccgagggttctgcggaagcaggcggcacagcctgcgaggggctttcgtttcccggactcagccgcatcgcctcggctcgggcgcgcctgcatcctgccgcccgtccgcgcgttgaaggggcggatacaaacaacgtggacttccgagcccctgattggcgagcgtgcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggatgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtcccc

SEQ ID NO: 5391 - DNA, 2569 bp, Homo sapiens
gccctggtggtgcgggaagcggcggggcggcggcgaggctgaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggatgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtcccc

SEQ ID NO: 5392 - DNA, 2609 bp, Homo sapiens
ggatttctctgggaggcagccgcagggaagggaatgatcttggtgaacttataatcgaaccaatggttccgggaaagcaggaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggatgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtcccc

SEQ ID NO: 5393 - DNA, 1627 bp, Homo sapiens
ggaccggccggagctttgcggagggcccggcttggcgggtccgggggggagccgaacccgcggggcaccgggtccgggcggggccgagccgggccggggcgggagccagccggggtggggcggggccgaggccgaggcaggcggtcggcagtgctgggggttcaggtgttgcggcggctccacgtagccaggcggcccgtgggctggagcgggcggagctcggcccgcggcttgcgtgagctcaggccggtcccagcgtccagagcgccggcccttcggcttcttctaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgagatgcagtcctgctatgttgcccaggctgatcttgaactcctggcctcaagcaatcctcctgcctcaacctccaagtagttggaattacaggtggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttc

SEQ ID NO: 5394 - DNA, 4467 bp, Homo sapiens
cggagctgaggaccggccggagctttgcggagggcccggcttggcgggtccgggggggagccgaacccgcggggcaccgggtccgggcggggccgagccgggccggggcgggagccagccggggtggggcggggccgaggccgaggcaggcggtcggcagtgctgggggttcaggtgttgcggcggctccacgtagccaggcggcccgtgggctggagcgggcggagctcggcccgcggcttgcgtgagctcaggccggtcccagcgtccagagcgccggcccttcggcttcttctaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagcca

SEQ ID NO: 5395 - DNA, 4230 bp, Homo sapiens
agactggtgtggcacggagctgaggaccggccggagctttgcggagggcccggcttggcgggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagcca

SEQ ID NO: 5396 - DNA, 4215 bp, Homo sapiens
aggcggagtcggggagggctgaggtgggcctgaaggcagagtcgaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagcca

SEQ ID NO: 5397 - DNA, 4203 bp, Homo sapiens
gggcagagtcgggtcggagtcggggcgcgctgaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagcca

SEQ ID NO: 5398 - DNA, 4193 bp, Homo sapiens
aggcggaacccgggtcgggctgaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagcca

SEQ ID NO: 5399 - DNA, 574 bp, Homo sapiens
ccatcaaatggggccctgggtcctctcctcacaaggattttgggctcctccgcagttttgtagccagcctggattctggccttctgcagcctgctccctcccttcccttccgcccctgggaagagcgacccccaccactctcggagactgcactgcccgcctgtcagagtgggcactcaggtgacactgctgtggtcgtccccttcctccgtgatccattccggagggggtcattcttagtctaggcctgcaggcccggagctccagccatggtctccgcctgtccctgaccggcggtctgggaggcagcaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagct

SEQ ID NO: 5400 - DNA, 4943 bp, Homo sapiens
gggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgattgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaatgctaa

SEQ ID NO: 5401 - DNA, 1361 bp, Homo sapiens
agagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagagaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcac

SEQ ID NO: 5402 - DNA, 1313 bp, Homo sapiens
ggagtcacggctcgcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctggaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaatatcttctgcattatatatctgtttttctcctactttggtaggtgaagaaactaatgcaaataattcttatgtgcactaaaccttgctatattgcctctc

SEQ ID NO: 5403 - DNA, 1504 bp, Homo sapiens
aggggcgagggtccccggataccgggtctatcacggtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctcca

SEQ ID NO: 5404 - DNA, 2450 bp, Homo sapiens
gtcacggctcgcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgcttttaaatcttggggattttggactgtcttggcaaatcctaagtatcatcttcattcttccttgatgtttaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaagtatggactggtgggcaccttggggctggtcagggccatcccagtttacacattacctaatataggaagcagaagttagaaaaggaaagcctgactaagtgtctcacttctagacttctttgttatatctcttagctgatatctttttcccacagcaaaattggcatttaaaaagggatagtgaggcctggcatggtggctcacacctgtaatcccagagctttggaaggctgaggcaggtggaccgcttaaggtcaggagttcgagaacagcctggccaacataccttttctctactaaaaacacaaaaattatccgggcatgatggtatgcacctgtaatcccagttactcaggaggctgaggcaggagaatcgcttaaacccaggaggaggaagtttcagtgagccaagattgggccactgcactcagcctgggcaacagagcaatactccatctcaaataaataaataaataaataaataaataaataaataaataaaactaaaaaggtaggccgggaacggtggctcacgtctgtgatcccagcactttgtgacgcccaggtgggaggatcacctgaggtcaggagtttgaaaccagcctggccatcatggcaaaaccccatctctactaaaaatacaaaaattggccgggtgcagcggtgggtgcctgtaatcccagctactcgggaggctgaggcaggagaatcacttgaacccgggaggcggaggtggcaatgaaccaagatcgtgccattgcactccagccttggcaacagagcgagactctctcaaaaactaaataaaaaaataaaaaggtataatgatcaagttaaaaagtttaaaccatacaatttataaagtaaaaaagtaaaagaaagaataagaaagacaaaaaacaaacagaagtaaaagattccccttcagcctttcctttccccgcctcaggtacatgcctgggtgattttttttctttttctttttttttttttgagatggagtctcgctctgttgcccaggctggagtgcagttgcccgatctcggctcactgcaacctccgcctcccgggttcaagcgattctcctgcctcggcctcccaactagctgggattaccagcatgcaccaacatgtccatctaattttttgcgtttttagtagagacagggtttcaccatgttggccaggctggtcttgaagcctgacctcaggtaatctgcccacttcagcctcccaaagtgctgggattacaggcttgagccactgcacccggccagatttttgtatttttattgtagagatgcagttttgccatgttgcccaggctggtctcaaactcatgagctcaagcaatctgcctgcctctgcctgcccacctctgccaccacactcagccaaaatttttaccttgcaaagtaaaattgggaaaattaagagatagcacattcccaagccagagtatttgggaaaaaaaaaaaaaaagacacatcacagtgtgacttttctctttccagaaagaatgggctttgtgattcttttaaagcagttttaaaagtttaaataatattggttttgaatatataaaactataaggaacaagaaaaaaaacatatgtatgtgtatatgtgtgtgtgtgtgtacatgtgtatgtactatcaccccaaaattaaattactgttaacatctc

SEQ ID NO: 5405 - DNA, 1365 bp, Homo sapiens
gcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgcttttaaatcttggggattttggactgtcttggcaaatcctaagtatcatcttcattcttccttgatgtttaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtc

SEQ ID NO: 5406 - DNA, 1466 bp, Homo sapiens
ggagtcacggctcgcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaatatcttctgcattatatatctgtttttctcctactttggtaggtgaagaaactaatgcaaataattcttatgtgcactaaaccttgctatattgcctctc

SEQ ID NO: 5407 - DNA, 733 bp, Homo sapiens
gggcgagggtccccggataccgggtctatcacggtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtg

SEQ ID NO: 5408 - DNA, 2039 bp, Homo sapiens
gccatgttgttccctccgcgctggacgggagcagctggagcgggagcctggctgcgctaccgcggctgcctcctgctgtgcaggtccccgaccctctctctgtcctcattgcgcccagacgggccggcccagagctcccgggtcgtctttcgtgtggccgcgagacactcttgcactcctgtaatgagcctggcactgtgatgaaacacttttcccgtgtcgtttgagtgcatcttctcaacaaccctaggagggttcttgaagcttttgagattaacaatggcaggaaaatcatcactttttaaagtaattctccttggagatggtggagttgggaagagttcacttatgaacagatatgtaactaataagtttgatacccagctcttccatacaataggtgtggaatttttaaataaagatttggaagtggatggacattttgttaccatgcagatttgggacacggcaggtcaggagcgattccgaagcctgaggacaccattttacagaggttctgactgctgcctgcttacttttagtgtcgatgattcacaaagcttccagaacttaagtaactggaagaaagaattcatatattatgcagatgtgaaagagcctgagagctttccttttgtgattctgggtaacaagattgacataagcgaacggcaggtgtctacagaagaagcccaagcttggtgcagggacaacggcgactatccttattttgaaacaagtgcaaaagatgccacaaatgtggcagcagcctttgaggaagcggttcgaagagttcttgctaccgaggataggtcagatcatttgattcagacagacacagtcaatcttcaccgaaagcccaagcctagctcatcttgctgttgattgttagattgttgatgcattctaaccaactcacacatatacacaaaatcaacatggggatggagaagagaattagcgtttgcagcagtgtatcatctactaataaaattaaactaatgttgctgcttcattagttggtgggagaagggacacatccactcttggaggaatatatttactcaataatggcaccttacatttataaattgtaacagttgtctaataacgtttctttaatttaaatatgtaagttgcagagctaataaatgaaatgaccaagactttaattataataaaaataagaaacttgactattctagaagttatacttggattttttcctgggaaaatggagaactactttttatatgtgtatgtttttatgcaattagcattgtattcttggttcagggaaatactttcctaaagcaataatgttagatattaaagattaaaatctaatgtatttgcaatgcattgttaatttacttcttcattctcttcaaaatgatttaaccattcctgttttcattctacatactagaattactctcactagtaattactcatcatttgtgtgccattcatgcacccccacccccataaatcatgttccacagtctcaggcggagggtgggcccccagtggtacaagagttgcttcatacagtctgtaatacatccagctaaattcaagttgtctatgaatggaaagcctttccatagatagagttcagttttaagaaaaaggctaactactgaacttggagaacagacaaatgtgcatttgataactgatgtaataattacaatgtactgtgtggaagatacaaaattacaattcgattaatggactaaatatttttgttactttcttgacccttggggaaagtttcttaattgaagttaaaacattcctttataacacaagacacaagctgactttatcactctcagaagaaatactaagaaggattgtactttgtgagagggtaaacgaagacatctttattcggcaatgtatttacttagtgtcttctctattactgaacatttagtgatttgctctcaaggagattttttgttagaaaaagacttgttgcagtgatcagacttgataaagcaaattgtggtcttttgtggatgaagttcata

SEQ ID NO: 5409 - DNA, 3251 bp, Homo sapiens
gagggaaaacagaaaaagaattgtgtgccactatgtctgaatatatcttctacttgtagataattacatccaagttgcccttttgcctttttatttccgtttttggacacctctttttatcatccagccaactggaatagacaaagcaccgctggtgccctgagcgacagaactctggtagggggctggctgtaaattgacgtggcatggaaattctccgctaagttgtagcagcttgcatgtttctctaagatcaagcccagcctcctggagctgtagcttaatcatgggttcaatgactttacagaaaaatggatagaaaaattcttcaactcctttctttggacccagatggttttttttgggttttttttttttttttggtttttgcttttttttttttttttggttatctatagtttagctgaaaacaaaatcaaagcagttaagtctgtaactttctttttgcagcttaaacaacagaatttgctgctctccctcccctttcctgcaatttaattccttacagattttgccatggggtgcggacttagaaagctagaagaccctgatgatagcagccctggaaaaatattttctaccctgaagagaccgcaagtggaaacaaagacagaatttgcttacgaatatgtattgctggattttactctacaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtggacaaagacgcccaaggctcgtgattgaggaatgtcccctaacttctgaggcacaaacaaatgacgcagcaaaagaactgatagaaaagattaatgtcgctgctaaaagaggaatgaaatttgttggattcatatcacagcattattctccatctaaattctgcaatggaaccaaccatgatggagatatagaatcgatgctacatgtgagacacggttcagatgaaaactgtagaagttggaatgaagggacgttaagtgggcagtcatctgaaagcggaattgaggaagaacttcatcatgaaagtggacagtatcaaatggaacaaaatggcagccctacttcctctaaatcaagaaagggagaagcctcagataacaaattgtatacagtcttcaatgcttttgatgatgattcaacctcctgggcctatcaggaaggcatcctgtcaatgaaagtaacaagaaaaggatcagtcattagtacacttgatgctgattggctggagttaactaccttttattataaacaaggcttgtctttaattgattcttttgtattctgggaaacatctaaaggggaacatttgcctaaatctttggaaggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacagtgaagggaatttggctacaaagcagatcgtattccttcagaggccagttatgtggaattcagctgctcaaacaccagataagaaagccagccgccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtgagccatgaggtgaagcaaaggaaggccctgtaaataattgttaaaatcattgccaactgaccttattgtattactttctctgcatttatgtaatatttttgaatttttccagacccagcctttcctctaatctatgtaaactttggcacaacctcccagacaaggaagaataaccaacatatttatacatttagaatcatgtttacacttctctcaactaaaacatctggttaaacagatgttccattcggttattacacaataatctatttcagcttctcatgaatgtacaaagtagactttcttacaattcctggtaaggagactgaatatctcaatcagtattttacccaattagagagagttctcaggaagttacagtcttatttaagctgaaaaataacctctctctctctttttttttctctctctctcatacacacacacagctaattagtgcaaataaatatctatttcccaaatataataattaatccacattttgtctttaactatagcatgtatatacaaagcaagcccctatgtgttaaaatattttttgaaaaaaatcttttttatgtatctttgcttttaaagggtcatgtcaccaaccctgtactgattcattgtacataaatgttgttgctcctaaaagcctaaaaatgcagacagcaaagcagcatctcttaaaattcaatatgaaaagaacccataatctcaatacataaataccttagtagagagtaagatttaatttttttttattttaaagtccaaatactatgaagaggaaaaatatcaacttcaatttgaaactgaagtcttttacatctgtctagatttgaattctgcttttattttgacttgttaaatcctgaagaatgttgaaacctagaattttcaatctggcaggagtagaaagatgctcatagcacacgcgatatgtatgataacatattttgtttcatcttgcttttctttccccttctaatagaggtggctttgccttgacccagcctttaacaatctttaaaattctacaaaataaaggattttcatttatctatgaaaggcttactttgaaagatggaacctccaagtgaattacaacttattctatcattgatgaattcagcctattatatatttttattaacattgatgttgacattgtaagatcattttaataataaaacatcatttttattg

SEQ ID NO: 5410 - DNA, 2982 bp, Homo sapiens
cgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagtta

SEQ ID NO: 5411 - DNA, 555 bp, Homo sapiens
aaatcttgaaggatccttgtctcccaggcgctcttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaa

SEQ ID NO: 5412 - DNA, 599 bp, Homo sapiens
gggtttgctctggggacagaggtgctggacgtgtaggagcagacatgccgcgcgctccgaggaagcgccggaaccaccagaagcacagggacgcgggtgccgagagtccccagcactgaaaacggggatctcctcttctcagctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccagga

SEQ ID NO: 5413 - DNA, 578 bp, Homo sapiens
gaggtgctggacgtgtaggagcagacatgccgcgcgctccgaggaagcgccggaaccaccagaagcacagggacgcgggtgccgagagtccccagcactgaaaacggggatctcctcttctctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccagga

SEQ ID NO: 5414 - DNA, 1137 bp, Homo sapiens
atggaccgggtctctggcgggtagtgggaaccgcgcgtggcgcctccctgcaggttgctctttgccggggctccggagctgccagagcagcaccccctggcccgcgtcggatggggacctgggctgatccttgggacgcctggatcttgggccaacttttttttgcggggaacgggtgtaggggagtcattcctggagcgatgtagggagaggcacttcggagcagcctgttgggggtcgtaggctctgcaggctcagaagcgcctaggaaggacgcagaggtgggggagcttggaggctacagctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcaggg

SEQ ID NO: 5415 - DNA, 3507 bp, Homo sapiens
ggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaaggaacagattataccattctctcggcccggtgacaagagtggcacgaaatggctatcgaagtcacatgaaggccagcagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgccttagaattttaatgaaaaatgacactcaaacaaaggctatatgtcgaatgttataaactcttgagacataatgaattttagcagtggcctagagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataatta

SEQ ID NO: 5416 - DNA, 2223 bp, Homo sapiens
actctcctcccccgagcggcagcggcggcggcggcggcggctgctgcgggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagaaaagtagcagctctgaatccttaagtgacaaaggctctgaattgaagaaaagctttgatgctgtggtattcgatgttcttaaggttacaccagaagaatatgcgggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacacc

SEQ ID NO: 5417 - DNA, 5834 bp, Homo sapiens
gccccgcccgcttggcgcgcgcccccgccaggtccgctctcgtcccccacccctggcgcggacggggtggttccagctcactctcctcccccgagcggcagcggcggcggcggcggcggctgctgcgggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagaaaagtagcagctctgaatccttaagtgacaaaggctctgaattgaagaaaagctttgatgctgtggtattcgatgttcttaaggttacaccagaagaatatgcgggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaaggaacagattataccattctctcggcccggtgacaagagtggcacgaaatggctatcgaagtcacatgaaggccagcagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgccttagaattttaatgaaaaatgacactcaaacaaaggctatatgtcgaatgttataaactcttgagacataatgaattttagcagtggcctagagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagtattctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagttttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaa

SEQ ID NO: 5418 - DNA, 1628 bp, Homo sapiens
gtggcagctgaaggagccttgctcccacagacaccgccatcccctcggaatctgattccacatggacataggaatttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaaggaacagattataccattctctcggcccggtgacaagagtggcacgaaatggctatcgaagtcacatgaaggccagcagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcatttgttttttatatattaattat

SEQ ID NO: 5419 - DNA, 3161 bp, Homo sapiens
ccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcg

SEQ ID NO: 5420 - DNA, 2607 bp, Homo sapiens
ccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttttctggag

SEQ ID NO: 5421 - DNA, 2664 bp, Homo sapiens
actgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataa

SEQ ID NO: 5422 - DNA, 2511 bp, Homo sapiens
ggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcg

SEQ ID NO: 5423 - DNA, 4537 bp, Homo sapiens
cgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttttctggagggtagattgtgtttgttggcacacccaccttttctgttccctagcatctgggatatgcaatgcttctatggctaataccacacaccaatttaatttatagaatgggctcctcatttacatctcagtcacagactcagaaataaattgtcagtttgtccttttatgtttaatattttacataaagcatctattctataaaaatctttagaaagagtttcccatttaattttgattttaaagaattatattggataaggtggttttcaccataagctaatttactctctgcagccgtctacattcttcacaaatcatgtggtacattgaagcctcttttacatgtcaacttgtgacaaatacaaacatgtgagattttatattttccttgtggaaatgtgatcaacttcatcagcgacttcgaactattttatgagattcaataattcagcagtcatgtaaacttatgaaataggtatgagtaatggcctttcttaatttttttaagtattgttttaaaacttctgaggatatcagttattcccagaataaagggaaattccttaggatttctagtttacctttagccatcttgtcactcattcttttgctatacagacaagtttttcctattaatgagtttctggagtatgccttattcaggacaatatgctgttttagattttgtttaatattaaatgatatatacatttcgatccattgctaacagcagatattccctttaagatttattctgtctataggatcatagattttaaactgcatggatatatcttggcagaatcagaagtgtggttttacaccaataaaacagcataatattttaacttttgttcatctttttaacaagatttaaagttttaagaaatagaagattttgtattttcatttctgaaagaaaaaatgtttaaatactatagattcacagtcctaaactgcaccgatagactttgttactgtaaacaagaatttgaagaacaagggaaactgacaacctcaagcttccaagattaatacaatttttacctgacaatatctaggtaaaaatatacatcagctgaagtttccaagtggctttcagtatggctttagttgttaaataataaatttaaagcattaaaggcccaggaaactactcaacacctgtttttctgagtgtctttgttttcaaagaaacatttttactcagctgtatttcattacaagcaagttttgctgtttccatttagttttgttttttaaaatatgctttttaaaaatagccttctaatttaacaatgtcaaaaatatttgttaaagcttcttagaatttagccttccaataaataacacttaaaaattatagaaaa

SEQ ID NO: 5424 - DNA, 439 bp, Homo sapiens
gagctgaatcagagcagtgagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagc

SEQ ID NO: 5425 - DNA, 3104 bp, Homo sapiens
acagagggtaactcagatcaggcttagaaatcacttgacttaactcagcagcactttttcttttctttgtgtctgtattattttagcagccttctctaaatactggaggcattggatttcatgtcgccaaaaggaatttaaaaatgacaaaagtgtaatctgttagaaatagttaatttgtagaattttactctataaggaggtttagtttcaatttgttttgaaatgaaggaattaagttgtgtttttaaccaaatgaattggcatctttatatttaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgaggaaaaacaatgtttttatgacatcagctcttgtgcaaagtagtgttgatataaagagtgctgaacaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataagatttctgagggaaattcctatttgttaagtgaaaatttatcaagggctagaatttcagtccagctgtctactaaccaggactttttaggtgcaacatcagtaggatgtcaaccaaatgaagataaatgttcttttaaaagctgcagttccaattttgtttttggagaaaacatggtagaaagagttttgggtactcaaaaactcacccagcctcaacttgaaaatgattcatatgccaaggaaaaaccattcaaatccattccgaaatttcctgtcaactttttaagttcaagaacagactctattaaaaatacttccctaattgaatcagctgctgcattctcttcccaaccatcacgaaaatgcttgctggagaaaattgatgttataacaggggaggaaacagaacataatgtgttaaagataaactgcaagcttttcatattcaacaaaacaacacaatcctggattgaaaggggcagaggaacgttgagactgaatgacacagcaagcactgactgtggaacattacagtcaagactaattatgcgcaatcaaggcagtctaaggctgatcctcaacagcaaactctgggcccaaatgaagattcaaagagcaaaccacaaaaatgtacgaataacagctactgatttagaagactatagcatcaaaatatttttaattcaggccagtgcccaagatacagcatatttgtatgcagcaatacatcatcgtcttgttgcacttcaaagcttcaataagcagagagatgtcaatcaagctgaaagcctgtcagaaacagcccaacaattgaactgcgaaagctgtgatgagaatgaggatgatttcatccaagtcactaaaaatggatcagatccttctagttggactcacagacagtcggttgcctgttcatgaatactacctactataaacatgacatctacaaaaagaggggtcaccctactgaaaatactaaaccaccctaactaatgagaagattctattcattccttgaagagtttttatagaaaagtttaagaaatgtaatttgttgcaattaacatttttatgttttacattttacattttgattattgtgcagaaactgacagaatttaaaaaaatggacttcagaagttcaaaatttatcatttttgaagaagtttatttagaataggattttataactaatttggactcttcatcacattgatggatataatacttagaattataaattgctagatttgataaatacctaacaaaatgtttatttttttcagtcatacttgaccacaaaacaaatattttactaaatttccagagtcatttctctgaaaaatagtataatggcatgataacatttcactaaatcctatttatcttctgggaaatattttaatttagcttttggatttcctaatatgataagcttatatattcatggtatgaattcctttaaaaagagcatctgctcttggacttgtatctgttgcatcttgtcaatgtttgactcatggtcagcatccaatagttgttaaatgaataaataaaatataatacattacctatgtatcaaaaagcatgtgtaagaaagccaaatatgttaactgttctactttatttatgtaattatattttcattagtattttagtagatggggctgtatagaaaaacaaatgtatcatatgtagccaaatgaatctttttcttaaatgatattattatagtaggctacagtaatttcaacaattttacaatagagttttgatcctcttctttgcgatttgtttcagagacacctcatgaatcacacaagaaaattagtctcagtacttatagccctatttcatttttcaattcagttttatcacaccatggcttcgaagtgactttgattgtgacccctaagcaattatctgattaggggataaaaattcataattccaagatgtttctgaaaatgttctgaacaatgacaacatatttggaatgagggcgtaatttcactaagtgatgcttcgaagaacaatattcatttggatatgcaaacacacattttcaaaagttatattactgtgttaccatacctgttataaaataataaaaatatataagtatttattaagtcaaa

SEQ ID NO: 5426 - DNA, 572 bp, Homo sapiens
agcttgcattttaattacaaacaaagtagcagaaatcaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgaggaaaaacaatgtttttatgacatcagctcttgtgcaaagtagtgttgatataaa

SEQ ID NO: 5427 - DNA, 2278 bp, Homo sapiens
agagggtaactcagatcaggcttagaaatcacttgacttaactcagcagcactttttcttttctttgtgtctgtattattttagcagccttctctaaatactggaggcattggatttcatgtcgccaaaaggaatttaaaaatgacaaaagtgtaatctgttagaaatagttaatttgtagaattttactctataaggaggtttagtttcaatttgttttgaaatgaaggaattaagttgtgtttttaaccaaatgaattggcatctttatatttaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgtcaaccttgtctcagaagcaaatgagatgttcatccgtcactaacctcccaaccttcccccattctgggccagtgaggaaaaacaatgtttttatgacatcagctcttgtgcaaagtagtgttgatataaagagtgctgaacaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataagatttctgagggaaattcctatttgttaagtgaaaatttatcaagggctagaatttcagtccagctgtctactaaccaggactttttaggtgcaacatcagtaggatgtcaaccaaatgaagataaatgttcttttaaaagctgcagttccaattttgtttttggagaaaacatggtagaaagagttttgggtactcaaaaactcacccagcctcaacttgaaaatgattcatatgccaaggaaaaaccattcaaatccattccgaaatttcctgtcaactttttaagttcaagaacagactctattaaaaatacttccctaattgaatcagctgctgcattctcttcccaaccatcacgaaaatgcttgctggagaaaattgatgttataacaggggaggaaacagaacataatgtgttaaagataaactgcaagcttttcatattcaacaaaacaacacaatcctggattgaaaggggcagaggaacgttgagactgaatgacacagcaagcactgactgtggaacattacagtcaagactaattatgcgcaatcaaggcagtctaaggctgatcctcaacagcaaactctgggcccaaatgaagattcaaagagcaaaccacaaaaatgtacgaataacagctactgatttagaagactatagcatcaaaatatttttaattcaggccagtgcccaagatacagcatatttgtatgcagcaatacatcatcgtcttgttgcacttcaaagcttcaataagcagagagatgtcaatcaagctgaaagcctgtcagaaacagcccaacaattgaactgcgaaagctgtgatgagaatgaggatgatttcatccaagtcactaaaaatggatcagatccttctagttggactcacagacagtcggttgcctgttcatgaatactacctactataaacatgacatctacaaaaagaggggtcaccctactgaaaatactaaaccaccctaactaatgagaagattctattcattccttgaagagtttttatagaaaagtttaagaaatgtaatttgttgcaattaacatttttatgttttacattttacattttgattattgtgcagaaactgacagaatttaaaaaaatggacttcagaagttcaaaatttatcatttttgaagaagtttatttagaataggattttataactaatttggactcttcatcacattgatggatataatacttagaattata

SEQ ID NO: 5428 - DNA, 6949 bp, Homo sapiens
gtgttaagcctttttgaggggagtctgtgtgcagtcagccattttagcttttttcttttttttttttttttcctctccttttcttttgcctcttgttcttcaatctcagaaatgatcttgttctcttggaagactgagagctgtgtgaggttttctcagtcttgtcatagcctaggatggttagagtttcaatgttataaaaatggagacgaacactgttgttcggattccttttctggtctacaagtgtgaagggtttttaagcttaccagtagtgacactttaagctgcagcttggttttccctcctccctttttttttttcctttttcttttaatttaatgctgtagagggtgacttgccatcgtgagagattggtacatgatgtgtaaattcagttcagcatatgtttcttcattatgaaaccactagcaatcccagctaaccatggagttatgggccagcaggagaaacactcacttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctggtcagtgattctcaatggatctgtggaagtgacttatccagatggaaaagcagaaatactgtgcatgggaaatagttttggtgtctctcctaccatggacaaagaatacatgaaaggagtgatgagaacaaaggtggatgactgccagtttgtctgcatagcccagcaagattactgccgtattctcaatcaagtagaaaagaacatgcaaaaagttgaagaggaaggagagattgttatggtgaaagaacaccgagaacttgatcgaactggaacaagaaagggacacattgtcatcaagggtacctcagaaaggttaacaatgcatttggtggaagagcattcagtagtagatccaacattcatagaagactttctgttgacctataggacttttctttctagcccaatggaagtgggcaaaaagttattggagtggtttaatgacccgagcctcagggataaggttacacgggtagtattattgtgggtaaataatcacttcaatgactttgaaggagatcctgcaatgactcgatttttagaagaatttgaaaacaatctggaaagagagaaaatgggtggacacctaaggctgttgaatatcgcgtgtgctgctaaagcaaaaagaagattgatgacgttaacaaaaccatcccgagaagctcctttgccttttatcttacttggaggctctgagaagggatttggaatctttgttgacagtgtagattcaggtagcaaagcaactgaagcaggcttgaaacggggggatcagatattagaagtaaatggccaaaactttgaaaacattcagctgtcaaaagctatggaaattcttagaaataacacacatttatctatcactgtgaaaaccaatttatttgtatttaaagaacttctaacaagattgtcagaagagaaaagaaatggtgccccccaccttcctaaaattggtgacattaaaaaggccagtcgctactccattccagatcttgctgtagatgtagaacaggtgataggacttgaaaaagtgaacaaaaaaagtaaagccaacactgtgggaggaaggaacaagctgaaaaagatactcgacaagactcggatcagtatcttgccacagaaaccatacaatgatattgggattggtcagtctcaagatgacagcatagtaggattaaggcagacaaagcacatcccaactgcattgcctgtcagtggaaccttatcatccagtaatcctgatttattgcagtcacatcatcgcattttagacttcagtgctactcctgacttgccagatcaagtgctaagggtttttaaggctgatcagcaaagccgctacatcatgatcagtaaggacactacagcaaaggaagtggtcattcaggctatcagggagtttgctgttactgccaccccggatcaatattcactatgtgaggtctctgtcacacctgagggagtaatcaaacaaagaagacttccagatcagctttccaaacttgcagacagaatacaactgagtggaaggtattatctgaaaaacaacatggaaacagaaactctttgttcagatgaagatgctcaggagttgttgagagagagtcaaatttccctccttcagctcagcactgtggaagttgcaacacagctctctatgcgaaattttgaactctttcgcaacattgaacctactgaatatatagatgatttatttaaactcagatcaaaaaccagctgtgccaacctgaagagatttgaagaagtcattaaccaggaaacattttgggtagcatctgaaattctcagagaaacaaaccagctgaagaggatgaagatcattaagcatttcatcaagatagcactgcactgtagggaatgcaagaattttaactcaatgtttgcaatcatcagtggcctaaacctggcaccagtggcaagactgcgaacgacctgggagaaacttcccaataaatacgaaaaactatttcaagatctccaagacctgtttgatccttccagaaacatggcaaaatatcgtaatgttctcaatagtcaaaatctacaacctcccataatccctctattcccagttatcaaaaaggatctcaccttccttcacgaaggaaatgactcaaaagtagacgggctggtcaattttgagaagctaaggatgattgcaaaagaaattcgtcacgttggccgaatggcttcagtgaacatggaccctgccctcatgttcaggactcggaagaagaaatggcggagtttggggtctctcagccagggtagtacaaatgcaacagtgctagatgttgctcagacaggtggtcataaaaagcgggtacgtcgtagttcctttctcaatgccaaaaagctttatgaagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttggcataaactctccacaagctttaaaaaaaattctttctttgtctgaagaaggaagtttggaacgtcacaagaaacaggctgaagatacaatatcaaatgcatcttcgcagctttcttctcctcctacttctccacagagttctccaaggaaaggctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaccgaacgagtctgacccgcgcctcgccccctatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgtttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaagccttgcctatattcttaa

SEQ ID NO: 5429 - DNA, 3604 bp, Homo sapiens
atactctgggctcaggcggatgtccactctggtacccccgggtgcggactccaaagcctgccagtgccggcccccttcccctacgcattcctctaccgtaaggcagggcgcctccaccccgccccctccgccagtcctggggaggggaagggggcgggcagcgcagggggtgtgacagctcccgcccggaccggtgccagcgcagccttgcttcagcgcccggtgccagctggctccttcgtctgagacgaaggcgcaggctcggggctccctgtcgccggtggctgggtggcgtccccccaccacgcccccacccctctactcacccaagaggagcctctccaccgagccctgcatcctgctgccctggcagccagtccagctaggcactggcccagttcactgtacctggacttacccactggcaccctccggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacacc

SEQ ID NO: 5430 - DNA, 3294 bp, Homo sapiens
gtgccagctggctccttcgtctgagacgaaggcgcaggctcggggctccctgtcgccggtggctgggtggcgtccccccaccacgcccccacccctctactcacccaagaggagcctctccaccgagccctgcatcctgctgccctggcagccagtccagctaggcactggcccagttcactgtacctggacttacccactggaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacacc

SEQ ID NO: 5431 - DNA, 3294 bp, Homo sapiens; identical to SEQ ID NO: 5430

SEQ ID NO: 5432 - DNA, 4092 bp, Homo sapiens
ggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggtgtctgcctggccccagtttctttcctctgctcctcctggactgcaggcccctccttcgccccctgaccctgaggggctctgtgggcgtgggaagctctcctcccacagacacacccttgggtctctgataggtgttcacggggcccttgctgcatgtggtgccctgggccaggccgtgccaggaggcgcagaggcctaaggtggcctccctcctcgcccactccctgactcaatgggccttttattccttttgggaggtaattcatgcccacaggtagagcctgggagatgaggaatggtggctggagttggcccctgaggcccacggggctcctggtggccagtgctgtgggagctcagaggaaggcgaggcccctccctggaaagtcagagggggccccaggccattctcagctggggcttaaagggaagcaaagaggggatgagaagatgtgactgcagccaggatttggttgaggaatggtgggagaaagaactggaaaggtagattaggttggtggtggggagggctgcactgggaataaaatccaggggcctcaccatccagcaggctccccatggtcccaccctactgtgtgtcccagcccctgcctgctggagactcttactggcttcttctcctccgcaggcgaagcccgttctcccctcagggcctttgcacttatcccttagcctggaagggtctttctctggctctgcctggcaggatccttctcgttctcatctcagccaaatgctgggttcccagacaggccccctcccgtctccctatccggagcaccctcccctttctcccaccacgctctgccttggtgtcctctgtgattttcttcaaagcactctcgccatgtggagttgttttctttgcctacttgctttctgtcctttggtatctctcccatcccactggagagttgacttccctcctgcgggcccccacctccgcttctccttgctcacatgctgcctggctcttggctgacgctcagaaactgatgtgggctcaccctcgcaggccgggcactgcgctaggtgctgatgctgcacctcattcaaccctggcctgtggggctgcagtcaggcaaggggcagagcagttcaacaacccgtgatgtgcagtgacacgggacactttccctgaatgtgcactggagtcggctcttccaactgtagtccgctcctgaaaacgggaggggaagagccaactccagtgcagattcagggaaagtgtcccgtgtaagcgactactggagttgagagctgcagggggcaagggtggaggaagaagaggattcctggtgggcaaacccaggaggaaagggaacccaggaggaggatccctggaggagcgagagtaagagtaggaccccagagcaggcaggaggtgggcagggccccctgggccaaggacaggggtctgatctttgtcctaagagcagtgcaaaccattaaaggggtttgagccaaggttggcaaagtctgatttgtgttttgaataggtcagctaaagagcctgggctttctccagcagacaatggacgccactgaagtcgagtgcgggagcttcacagggctctggtcaggcagattggaggaggagggctggaggcacctgggagggaggaggaggagcatagttgggccattggagtagataaggagtgaggcctcgtgggcaggtggaactggagttagcctgggcaggggaggagggggcacagaagacccacttcaaagaagaatcttcaaagcaagatgacaagctacggaagtgtggaggagcctggagctggggagaatggctggggaacagagtggtctgggaggcaggatgcaaggatccgatgggtatatggagtgtgaggtaatggatcattcatgtggaaggatgcagggggtttttgagaccagggtttggaagagagttcagcactgctggtagttttgggaatcacccatgtgcaggcgacacatgaggcagtaaggaactctgcaggggtccctgagatttggaaatgtagggaagagcaatggattgaggtccgaacctggaggatctgctatacgcagagctgggaggagggacagagtcagtaccagagtcggaaaaaagcagggtgggaaggggaacctgagtcaggagacttgcctggcaggcgctgccctgccagcagaggcctgacagtggtttccatgaactgcatccctgctgtgggctgggacagggccactgacacagtatcggagcacagagggggaaaggagcaggagggattccaactctgccagttagcagctgtgtggctttgggcatgttacttaacctctctgagcctcatttatttcatccataaaatggaaataaaaataatacttttgtcaaa

SEQ ID NO: 5433 - DNA, 2776 bp, Homo sapiens
tcctttaggagctgccggtggagagtgagtgctggtcctgtggaggagggagcaagccccgtggtccggagtgcatttccatggatggcttcagagctggccaggatggacagtactccaggcagtgggaaccgcacgtgtgatggcgcagagggaagaaataaagcggccgctttgggaaactgtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagca

SEQ ID NO: 5434 - DNA, 5751 bp, Homo sapiens
gttagtcagggctgaggaggagaggagaagggtttaagccgaagctgcatttctgggagacctagtgaatctatagcttcatactgggaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaactgacagcttcttcccaactgcaatccccgcttttccacacttgagctcgtcctggcctgttgggccaggcttctggggtcttctgggggtggcttgtgatagaaacaatgctgaagcttccgcggagagcccgtcgcttgttgaggcccaacagacttccaggaaatcagggtttatcatcagtgttgagaatggtcccagcaagctctggtcatacgaagtcctctcttccctgccccttcagcacttcccctaggaaccagctactgccaggacgcctcttgcgaggcagagctcacccaggaagctccagggactccaccctcttgccttgctattgccctgagtcctggcagcaggaggcacttgtctggccagagagagaactcatggcccctggcatgactcctgagtaggtattgaggctgcagggccttgggcgtccagaggcagctggtatggcccctctgcacttcagccccatggatgtggatacacaggcctgctgcttccagaaagggtcagagcctttagcagggaggcagcacagctgggcttagacctcaggtcactaagtgaatctgagcaagtcagtgaacagttctcttccttcatttctccacctgtaagccaggtatgataaacgccatacagcgcttagtgacaaacacataaaactgtagctcctgcctctgtagcagaggtgacagccaagggcagtcctgtgctatccaggcctggtaggggggcagcctcgcctcagttgagggctgagggagagactgaggtgcagcagatggcagtggtaaccaaaccagttcccttgccgtgggtggggacacaggagaagcacggaagcatctggaactgagcaatcaggacaggaggctcaagcctgggtgagtcaggagtccgggggctttcttttcatccaacccattgtctgctggtgtctcggcaaaagccagccagccagccgtggcccttcaccgttcttcagactctagggtgagcccagcccagcgacacaacagaaaccaagtgccacgggggccggtgtcctccaccagcatttctcctctggtcacatctacgtcctgatgggacttctccctcctccttggaccatcagctttacagtccagaccaccctgcagccacccggtggtctcccagctgccccagtctcgggcaggatggcttttgagcctgttgggagagaccttgccaggagaatggtgcccagggcaggcaagaggacacagactctgggagctagaagagttgcggcccagggggccaggccactcccagaggacaggaggcccaaaagcggggaaaggctccatgttacggtggccccatgctgggagtttgtgctgccttctgtctccctgactgcccaagcgtggggtggtgtggggcaggaggcatcctctggtgttccctagcagcccaggctgtgtgcaggggctcccattttgtgtctcagctgcaagaaggccacaaagggaggaggggctcatgggactgctgagaagaaggtgtgcagaaagggagtgtggccctagatcagtcctttaaaaagcctctgttacctgaaaggaggtcaagcagagaggaatggctgcgtgtgtgtcctaccgggcaggacaggacagagggaggtcattgttacacacacatcccccctcctttcctccttcccctccacttccctgtgaaggcctgaggcaggctgtggccaggctcaggccctgactgtggggtacacaccagggagggccacgcctccccacagacggggtggagtggtcagtggagccagcaccctctgctgcttcagcatctccgcctggagccagctgtcccctctctctcaggctccatccgaacaaaaggaaggcagagcctgagatccggcaccccatccccctccactcagcactgagttagagctgggtgggggcatgtctgccttcacacgctgccttatggcttctgtgtctccaacagccctcagcctctggctgctctccttcccaatagtcacaagatttaccatgataataataggttaagacttg

SEQ ID NO: 5435 - DNA, 3370 bp, Homo sapiens
ggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctg

SEQ ID NO: 5436 - DNA, 855 bp, Homo sapiens
ggagaagggtttaagccgaagctgcatttctgggagacctagtgaatctatagcttcatactgggaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaacc

SEQ ID NO: 5437 - DNA, 648 bp, Homo sapiens
agtccagaggactctaaggaagtagttctgcctggggcagttgtactgtggcccagccgccccagtcgtgtcccatggctgtccactttcctccccgtgtcacaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccgg

SEQ ID NO: 5438 - DNA, 2663 bp, Homo sapiens
gtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggcccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccag

SEQ ID NO: 5439 - DNA, 3265 bp, Homo sapiens
aggagctgccggtggagagtgagtgctggtcctgtggaggagggagcaagccccgtggtccggagtgcatttccatggatggcttcagagctggccaggatggacagtactccaggcagtgggaaccgcacgtgtgatggcgcagagggaagaaataaagcggccgctttgggaaactgtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttcc

SEQ ID NO: 5440 - DNA, 4338 bp, Homo sapiens
ccctccctctccccaccgccccaggccgcgggagcccgcggggagggcgggcctgtcgcagccgcgctggtcgccaggcgtccgggaggagcggggtccgcgcggcggacgaggcgggggcggaggcgcaggcagagcgagcgcgggaggtcgccgcagccagggacaccgcgcgccgccgctcaacatggtcgctgcgcacgctgcccattcttcctcctctgccgagtggatcgcctgcctggataaaagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggagaaatatcgacagtatatggcaggacttctggctcctccttatggtgttatggaaacgggctctaacaatgacaatatttttaaagaaatgacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcg

SEQ ID NO: 5441 - DNA, 4299 bp, Homo sapiens
gggcgggcctgtcgcagccgcgctggtcgccaggcgtccgggaggagcggggtccgcgcggcggacgaggcgggggcggaggcgcaggcagagcgagcgcgggaggtcgccgcagccagggacaccgcgcgccgccgctcaacatggtcgctgcgcacgctgcccattcttcctcctctgccgagtggatcgcctgcctggataaaagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgac

SEQ ID NO: 5442 - DNA, 4120 bp, Homo sapiens
acagttctgattcttttaaaccaagcggaagcctgcttcgatgacttggacttatgtctgcaccagggtctcattcctgtgtcttcaagcttttccatggagtggcaaaatgattcaaatccagaaaggaagggagtgaagttattaggagctaactaaagttaaaaaaaaaaaaaaaaaaaaaaaaggaagtgttttcttattgccttagactgcctgagctttcctggagaaccatcagcaccagtttcctttctgtggactgagagccactcagtagtagacacgaacagggaatgaacggcaatgaaggtacattttgctgatcaaataaaggatagatgctcactggatgtctgagaactttgagagaccgaaaaagaaggacgtatgctctacaagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgacaagaaa

SEQ ID NO: 5443 - DNA, 3975 bp, Homo sapiens
gcgcgccgccgctcaacatggtcgctgcgcacgctgcccattcttcctcctctgccgagtggatcgcctgcctggataaaagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgacaagaaa

SEQ ID NO: 5444 - DNA, 2722 bp, Homo sapiens
attccatctgttcctcaactcttacaaaagctagccataccatctctctctctagcttctgaagtggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagctta

SEQ ID NO: 5445 - DNA, 2930 bp, Homo sapiens
agattaccaatgataaagccggggctacggctaaagaaaggtaggatgcatacgcagaaacattagtgctaatatgctgcagaaaagccaagataaatcagtccagctctcatacatcactaagggagaagctgattgcaacttgaccatgttgcctgagtagtcccatcagtgagaagaggagaacatggatttaaaaaaaactagaatgtacccctagggctcctgccgtggtggacctgggagaagtgtctggtaaatatcgacagtatatggcaggacttctggctcctccttatggtgttatggaaacgggctctaacaatgacaggattcctgacaaggagaacgtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagg

SEQ ID NO: 5446 - DNA, 2961 bp, Homo sapiens
agatagatattttgtaagattctagtcaatgtcagtatttaaactcctggaccatatgtggcttctcttagcagattttgcaaaggaaacttactccagtatgcaagactaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatc

SEQ ID NO: 5447 - DNA, 1370 bp, Homo sapiens
aataccgtgacttcatgttgaaggtgccaagaacaacttcagctctccagtctctgaggaaatgtttgtttttgtacttacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatca

SEQ ID NO: 5448 - DNA, 3229 bp, Homo sapiens
aaagaaaggtaggatgcatacgcagaaacattagtgctaatatgctgcagaaaagccaagataaatcagtccagctctcatacatcactaagggagaagctgattgcaacttgaccatgttgcctgagtagtcccatcagtgagaagaggagaacatggatttaaaaaaaactagaatgtacccctagggctcctgccgtggtggacctgggagaagtgtctggtaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactc

SEQ ID NO: 5449 - DNA, 6237 bp, Homo sapiens
gagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaatgtgatttatttcttgctttgagattggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggatgaaaaggagggagagaaggtggaaatggtttttttttttttttttctattttctttctttttttttttttttttttttggtcaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttggtataccttaggtctatgaagtgtagctgaaatctgaagagtcttgacaaagggatttacacccttgacaaaaccaaaagaaattaacaggccacaggtttctttaaagctgtgttaacatatcttgccttaaaatgtgtgtgtgtgtttttgctttgcttttttttttttgcccaagaggcatctcagtactccagcaatggaggaagaatagagaattttgcctggcaatggtcctactgccattttttttttcccactctgatctcacttaagtttgatatcaaacacaattgggaggcaatagtatcaatatcctaaatgtagaaattaaaagatactgtataattttatgcctttgcaaagattcgttcttgtatttgaataaattcagttgctaaagtagatccaaagtgttaaaaatgctgaagtcatgtcaagtactgtctggagggtttttttaagaaaaggcatttggcatttaactgtctcttgttttatttttaagtttttggaaaccttttgacataaaatgctgccaagtatctaagaaatgtatatactgacagaagatatttgaaagtggaaaattggaaatgaaatatgttgctgggtgcgttaatcacctccgcccaggatttagtcacttgcaggacctctttatagtctaggatggcagagcagaagattttaatatgcttttattaagtgatgtaaaataaatgctttttggattatcaatgaaagcaattttatgtgtgcctgaagcaagaaaatagcgtttttggttttatctcatattttcttggcaaaattgagagaaattaggaacactgctatttttttcttaaaaatgtttttaagaatatgttcgtttctttgactattaagaaccccttgtggtattagtgtgtgaagagataagggcatttgtttcaatgaaaaagttagtgttaaaggaagtgagtcagggagggcggagtttgttgtaaggcaatcacctgtcaaaacagaaattgggtgggaaaggagtctttatcttggggagcaaaagctgacttttaaacttgacccctgctgtttttaaacagcttttccttttggtctctgacagtcaatccaggttttatgttatttcaaaagggttatttttgtcctccttttttaatagcttcaggaaagttaaaggtatcatcttaggtctaacactctagtctttgagagttacggttctttcgtagaacaatttccatgttgttaactgttgtagacttaattgaatcacattttgggaccagatgtatttggggatagaattctttaaatgtatgggacttcatgcttcctgattatgtaatatttcctgtggttgggaatcctagaatgcctgatctattttatctgttcaggtagttttgttattgtaccctcttttgggtcatattctagtatttctcacagggggtatgagaaacagaaagctatatgtagcagctggtcttgagaagtagaagcatcttaactgtcataagagcatagattttttgtttttcacaacagctggaataagttcctgcattataagtataaagggaaccgagatttaatttggagatcatcactgttaaaacgataccagacatttgtcacagtgtcttatttggggaaagtttgctaatatacattttgtctgtgaaaatatagtaaattttaaaatactaatataatgtggtattcttgattacagtattttatgcagactattaggaatgattcagtgcatttaactgaacacagagctagttctaggtgagtgagatctttatctattaactggattttgaaggtttgagaaggctatggggatcatctggttgaaaggttctcaaacttgaccatatatcaaaatcacctggagcttaaaacatgtactgctgggaccctcctccagtttcttacccagtgggtctcgggtagggtctcaattttcatttctaacaagtttccaagtgattgtgttattgctgttccagggaccacactttgaaaaccagtgatctagactgaactccaaatgagtactatactgacagccacctagatattgagagacacagacttcagactcatgtcacacattttggagtgctgtctactacagttagagaataatctctattgaaatctaagctaaagaggacatataccatttatactaagactaactgttgtgtgtgaaatagaataaacattgcaggtagtttttgatcattttcacattattacaggaacattttgactatggttttcaatgttaattcagaagttgactttaaatgaaaatgtggttagaatagaggcaaagcctaagtgatcagaatcaacattccccttctccccaacctaggggaaaaaaaatttgaaaagtatgtcttcaataaaaggggacactttatttgtcttctcttcaacattaaaaaacaaagattttaagttttcatggcaagggttctaaaaatcattgtgccagagaatttaaatcttcatatcatggtaagcacatgcgtatgtctgtgactcagtttcttagccagacttccaggtgttagttaattccttctcatttagttctactgtaatccattctgggaaaatgcataccacaaaactgtgtatcttgcagcttctttcgttatgcatcttaattccctcagaaggtcccagaactttatgttaaagatctgggtttttaaagacaatttgggggccttctaaagaaacaatagtagatctaattacaagtagtggattgcttacttcaaatttctcttttacaatttagaaagtttagtaccagtttatagactgagggagtagtagctactatttagatgctgagaataatattatcatgcttgggtggggaagaaaggcccttactcaaatctccattttcatttttaatgcttcctggacttcagttattttcttgcttttgcctcaagaataataaatatttttggttaaaa

SEQ ID NO: 5450 - DNA, 3896 bp, Homo sapiens
ggtgggggtgggggtgggggtggggggtgggtgagaaaaaaaagaggtgggttcgcctggagtccctgcggccgccgcggaaggcccccgcttctttccccgcggcgagcagcagcgctggggcagcggagagacagaggagccagcgggtggccatggccttggcgtgacagagcctccccggcggccgggcgggtgcggacggcggggccggacgacccccgcgggagccggggcccagaaacccgcccgggcagcggtaactggaacggagccctcaggcctgagccggctgggctgcgcgagcaggaagcggggtccctgggcccctttgtgtgaagggcgggggaggagtgccgggcagccccgggctgcgggctcctccgacgtccgcctcgccgcagggtcccctcgccgcagcccccaccctttccctcccgggggcacgcgcctcctcgccaccctcgccgggcttttcccaggctcgccctcctccccacgccccctgctcgggctgcagttcctataggaagggcattaccatcccttccccaccctccccgactctacgctctttcccctccccctcctgtaacttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctctctctcaaaattacagtgttcattgtcattgacctcagcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactga

SEQ ID NO: 5451 - DNA, 2333 bp, Homo sapiens
cgctggagagatggcaccggcctgaggtcaaggagaaattgaactaaactctcctttgaagactgtttccagaggcccgttcccgaagccggagtcccgacccgaaaccgtccccggccggctcgctcgctcagcagggcgcggctccagcgccacccggctcgccccgaagagcagcgctggggcagcggagagacagaggagccagcgggtggccatggccttggcgtgacagagcctccccggcggccgggcgggtgcggacggcggggccggacgacccccgcgggagccggggcccagaaacccgcccgggcagcggtaactggaacggagccctcaggcctgagccggctgggctgcgcgagcaggaagcggggtccctgggcccctttgtgtgaagggcgggggaggagtgccgggcagccccgggctgcgggctcctccgacgtccgcctcgccgcagggtcccctcgccgcagcccccaccctttccctcccgggggcacgcgcctcctcgccaccctcgccgggcttttcccaggctcgccctcctccccacgccccctgctcgggctgcagttcctataggaagggcattaccatcccttccccaccctccccgactctacgctctttcccctccccctcctgtaacttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactt

SEQ ID NO: 5452 - DNA, 1923 bp, Homo sapiens
atgtgtgtgtgtcgggggggggggtggtatttaaagggaaaagctgacagtgctgctgagtgagggagagggtgctgcgagctgctgggctgcacacgcacacgcacacgcacacgcacactgatgcacacggacctggacacagacatggacatggacacagaaaccacagcactctgcccctctggcagccgccgggcctcccctccagggacgcccacaccagaagcagatgccacgctactaaagaagtcagagaaactgttggcagagttggaccggagcgggttaccctctgcccctggggcccccagacgaagaggcagtatgcctgtcccctacaagcaccagctccggcgggcccaggctgtagatgaacttgactggccacctcaggcctcatcctctggctcgtctgactccttgggctcaggggaggcagcccctgctcaaaaggatggcatcttcaaggtcatgctagtgggggagagcggcgtgggcaagagcaccctagcaggcacttttggtggtctccagggagacagtgctcacgaaccggagaacccagaggatacctatgagagacgcatcatggtggataaggaggaagtgactctagtcgtttatgacatctgggaacagggggatgcaggagggtggctgcgggaccactgccttcagaccggggacgcctttctcatcgtcttctcagtcaccgaccgacggagtttctccaaagttccagagaccctacttcggctccgggctgggaggccgcaccacgacctacccgttatcctcgttggaaacaagagcgacttggcccgctcccgggaggtatcactggaggagggccgccacctggccgggacgctgagctgcaagcacatcgagacgtcggccgcactgcaccacaacacgagggagctcttcgagggcgcggtgcgccagatccggctgcggcggggccgaaaccacgccggaggccagaggcccgatccgggcagccccgagggccctgcgccacctgcacgccgcgagagcctcaccaagaaagccaagaggttcctcgccaacctggtgccgcgcaacgccaagttcttcaagcagcgctccaggtcgtgtcacgacctctcggtgctctgagccgcggtcgccatggccactgcggtcgccatggtcaccgcgccctccgctcgccccccctcgccccgccccgcccccgtccggcttccttggtggaggccgtctaggaaaccaaaaactcccaggatgccccggtgtgaccgccgggggcggcccggggccgctcggcggcacctccacacccgccccaacgcgttctctggagctttgggcctcagggcgcctagaaggcgaggacgcagacctgaaggcggccggtgagcggggcgggttctgctgggtcgggaagaaaaataattctgcaaggtattttgttttttattaattcgcgcttggccacctcatctgtaaagagattctaaaagcaagatctggaaaagtgcttcgtagactccttgacggagtttgcctcctttgtacgctgcgtgaacatgcctcacctttaagagagtcttaaaggtaaagacacgaaaacacttcctccagggaccttcccgaaaacgttctggctctcatctggtgcggcatgtgtccactttgcctttaaggagttcttaaaggcaagggcctggaagtgctgttcctgagatggattctcttgacttaccagtccaccacggcacttcccctttaaggttattaaaggtaaggggtggacagactttctgcattcagataatgagcagtggcaaccccttttggccagggccaggggggcaccagcaaggggccaccctttcccttttcaataaataatttttgtactgcctctgttca

SEQ ID NO: 5453 - DNA, 1331 bp, Homo sapiens
gagtgagggagagggtgctgcgagctgctgggctgcacacgcacacgcacacgcacacgcacactgatgcacacggacctggacacagacatggacatggacacagaaaccacagcactctgcccctctggcagccgccgggcctcccctccagggacgcccacaccagaagcagatgccacgctactaaagaagtcagagaaactgttggcagagttggaccggagcgggttaccctctgcccctggggcccccagacgaagaggcagtatgcctgtcccctacaagcaccagctccggcgggcccaggctgtagatgaacttgactggccacctcaggcctcatcctctggctcgtctgactccttgggctcaggggaggcagcccctgctcaaaaggatggcatcttcaaggtcatgctagtgggggagagcggcgtgggcaagagcaccctagcaggcacttttggtggtctccagggagacagtgctcacgaaccggagaacccagggggatgcaggagggtggctgcgggaccactgccttcagaccggggacgcctttctcatcgtcttctcagtcaccgaccgacggagtttctccaaagttccagagaccctacttcggctccgggctgggaggccgcaccacgacctacccgttatcctcgttggaaacaagagcgacttggcccgctcccgggaggtatcactggagggtgtgtatcctgaacagattccatacttgcgatctcaggggaatgctctcccttccaagtcacctcttctccctaaggcctttttaccatcgcggacgcactcacttgcaatcagacccaggctagggggacactcccaatgccccactcgaggatcctgagaatcccttcttgtcacttcccctcacctctctcctaggcctccttctccctctccttcgcacctccacagacccaccatatgagctcagccatgttctctcggttgcaagattcactagtaccaatcccttgccaccgcacgcccaggccctccctagacccaccctcgccccgggtcccgtacagcccagcgggcgcctgagccggtgccttcctgcagagggccgccacctggccgggacgctgagctgcaagcacatcgagacgtcggccgcactgcaccacaacacgagggagctcttcgagggcgcggtgcgccagatccggctgcggcggggccgaaaccacgccggaggccagaggcccgatccgggcagccccgagggccctgcgccacctgcacgccgcgagagcctcaccaagaaagccaagaggttcctcgccaacctg

SEQ ID NO: 5454 - DNA, 1665 bp, Homo sapiens
ctgaggcgggtggtacagcctggagcatccagccgctggagctgcgagggaccctggacccctcccacgccgaggtttatgcagagcctgaggccagaaaacctagggactttctgccccaagaagctgaggcacctcctactcccatctgaacaagagggggatctggaagaagccatacagcagctcatcaggacactatagaaagaagcagctcaaagcaattggctgacagccaattcccccttctttcagaaggaaagaaggaagaagcaaacccccccctaccaaagatgacactcaacaccgagcaggaagcaaagacccctctgcaccggcgagccagcaccccactgcccctgtccccacggggccaccagcctggccgcctgagcacagtgccttccactcaatcccagcatccccggctgggccaatcagcctccctcaaccctcccacccagaaaccttcacctgccccagatgattggtcttctgaatccagcgactctgaaggctcctgggaggctctctaccgtgtggtgctacttggagatcctggagtggggaagaccagcttggccagcctctttgcagggaagcaagagagggacctccatgaacagctgggagaagatgtatatgagaggaccctcacggtggatggagaagacaccacactggtggtcgtggacacctgggaggccgagaaactggataaaagctggagccaggagtcatgcctgcaggggggcagtgcctatgtcatcgtatactccatcgcagaccgaggcagctttgagagtgcctctgagctccgcatccagctgcggcgcacacatcaggcagaccatgtgcccatcatcctcgtgggcaacaaggcagacttggcccgctgccgagaagtctctgtggaagagggccgcgcctgcgctgtggtgttcgactgtaaattcatcgagacatccgccacgctgcagcacaatgtggccgagctcttcgagggcgtggtgcgccaactgcgcttgcgccgccgggacagtgcggccaaggaacccccagcaccccgacggccggccagcctagcccagcgcgctcgtcgcttcctggcacgcctgacagcccgcagcgcacgccgccgggcactcaaggcccgctccaagtcctgccacaatctggccgtgctctgaagccccccgcccttctgagagttggcgggtcactgaggtgcattctgggctccagggacgccactgcggggcaaaggcgccgttacctggagtctgcatcatgggtcttgcttgcctgctgccctgatggcctgagcatcccccagatccaagcctgggggatcccgggaaagcgatggacagacagacgatggggccgaagccccaagctgggcacaaagtagttttttacgtggtgggtgtctttttgtaaaaaaatcttccttgtccctgggctctggccaaccctcagaaaccctcacaataaaccagaccagaaggatgtcccatctgaatgcccagacctctccatctcggctcttccaggcgtctccacctactgccctcccatctacacttgactgtagactggtctggcctgctggcctgggcgtcagggcgcatcaataaagtacttggaccagttttgtgctca

SEQ ID NO: 5455 - DNA, 2693 bp, Homo sapiens
gtggacacacaagagttaactggcgggtgtgacaggcggaccgccctcaggaagtgttactcactggggatgtgcgtgccttgccttgggactggattctcttcctgaagcgaaggagctcccagccatggaaagccctggagagtcaggcgcgggctctcctggagcccccagcccgtccagcttcactactgggcacctggcgagagaaaagccagcccaggacccactgtatgacgtgcccaatgccagcggcgggcaggcaggcgggccgcagcggccggggcgcgttgtgagcctgcgggagcgcctgctgctcacccggcccgtgtggctgcagctgcaagccaacgcagcggccgcactgcacatgctgaggaccgagcccccggggacgttcctcgtgcggaaatctaacacccgccagtgccaggccctgtgcatgcggttgcctgaagccagtggcccctccttcgtctccagccactacatcctggagagccctggcggcgtctccttggagggctcggagctcatgttcccagacctagtccagctcatctgtgcctactgccacacccgggacatccttctcctcccgctgcagctccccagagccatccaccacgcagccactcacaaagagctggaggccatctcccatctgggcattgagttctggagctcctccctcaacatcaaggctcagcggggcccggctggaggcccagtgttgccccagctgaaggcccggtcccctcaagagctggaccagggcaccggagccgccttgtgcttcttcaaccccctgttcccgggggacctagggcccaccaagcgggagaaattcaagagaagcttcaaagtgcgcgtgtccacagagacctccagccccctgtctccacctgccgtgccacctccccccgtccccgtgctgccaggggcagtccccagccagacagagcggctgcccccttgccagctgctacggagggagagctcagtggggtaccgcgtgccagcaggcagtggccctagccttccgcctatgccctccctccaagaggtggactgcggctcccccagcagctccgaggaggagggggtgccagggtcccgggggagcccagcgacctcaccccacctgggccgccgacgacctctgcttcggtccatgagcgccgccttctgctccctactggcaccggagcggcaggtgggccgggctgcggcagcactgatgcaggaccgacacacagccgcgggccagctggtgcaggacctactgacccaggtgcgggctgggcccgagccccaggagctgcagggcatccgtcaggcgctgagccgggcccgggccatgctgagtgcggagctgggccctgagaagctgctgtcgcctaagaggctggaacatgtcctggagaagtcattgcattgctctgtgctcaagcctctccggcccatcctggcagcccgcctgcggcgccggcttgccgcagacggctccctgggccgcctagctgagggcctccgcctggcccgggcccagggccccggagccttcgggtcccacctgagcctgccctccccagtagagttggagcaagtgcgccagaagctgctgcagctgctccgcacctactcacccagcgcccaggtcaagcggctcctgcaggcctgcaagctgctctacatggccctgaggacccaggaaggggagggcgcgggtgccgacgagttcctgcctctgctgagcctcgtcttggcccactgtgaccttcctgagctgctgctggaggccgagtacatgtcggagctgctggagcccagcctgcttactggagagggtggctactacctgaccagcctctctgccagcctggccctgctgagtggcctgggtcaggcccacaccctcccactgagccccgtgcaggagctacggcgctccctcagcctctgggagcagcgccgcctgcctgccacccactgcttccagcacctcctccgagtagcctatcaggatcccagcagtggctgcacctccaagaccctggccgtgcccccagaagcctcgattgccaccctgaaccagctctgtgccaccaagttccgagtgacccagcccaacacttttggcctcttcctgtacaaggagcagggctaccaccgcctgccccctggggccctggcccacaggctgcccaccactggctacctcgtctaccgccgggcggagtggcctgagacccagggggctgtgacagaggaggagggcagtgggcagtcagaggcaagaagcagaggggaggagcaagggtgccagggagatggggatgctggggtcaaagccagccccagggacattcgggaacagtctgagacaactgctgaagggggccagggtcaagcccaggaaggccctgctcagccaggggaaccagaggcagagggaagccgggcagcagaggagtagcttgaagtggccagaagggtcattcggggcgggagaccctgagcctgctgagaaatccttttagcgccagcaagccccacccagggccctgtcctgtgtctgccaccacctttgtctgatacttgtttccagggaagctgggggaactgccacatctgaggaactggaataaagatgagggggcttcgggggcccccagactgtgtgcccaagg

SEQ ID NO: 5456 - DNA, 2084 bp, Homo sapiens
agccatggaaagccctggagagtcaggcgcgggctctcctggagcccccagcccgtccagcttcactactgggcacctggcgagagaaaaacgttcctcgtgcggaaatctaacacccgccagtgccaggccctgtgcatgcggttgcctgaagccagtggcccctccttcgtctccagccactacatcctggagagccctggcggcgtctccttggagggctcggagctcatgttcccagacctagtccagctcatctgtgcctactgccacacccgggacatccttctcctcccgctgcagctccccagagccatccaccacgcagccactcacaaagagctggaggccatctcccatctgggcattgagttctggagctcctccctcaacatcaaggctcagcggggcccggctggaggcccagtgttgccccagctgaaggcccggtcccctcaagagctggaccagggcaccggagccgccttgtgcttcttcaaccccctgttcccgggggacctagggcccaccaagcgggagaaattcaagagaagcttcaaagtgcgcgtgtccacagagacctccagccccctgtctccacctgccgtgccacctccccccgtccccgtgctgccaggggcagtccccagccagacagagcggctgcccccttgccagctgctacggagggagagctcagtggggtaccgcgtgccagcaggcagtggccctagccttccgcctatgccctccctccaagaggtggactgcggctcccccagcagctccgaggaggagggggtgccagggtcccgggggagcccagcgacctcaccccacctgggccgccgacgacctctgcttcggtccatgagcgccgccttctgctccctactggcaccggagcggcaggtgggccgggctgcggcagcactgatgcaggaccgacacacagccgcgggccagctggtgcaggacctactgacccaggtgcgggctgggcccgagccccaggagctgcagggcatccgtcaggcgctgagccgggcccgggccatgctgagtgcggagctgggccctgagaagctgctgtcgcctaagaggctggaacatgtcctggagaagtcattgcattgctctgtgctcaagcctctccggcccatcctggcagcccgcctgcggcgccggcttgccgcagacggctccctgggccgcctagctgagggcctccgcctggcccgggcccagggccccggagccttcgggtcccacctgagcctgccctccccagtagagttggagcaagtgcgccagaagctgctgcagctgctccgcacctactcacccagcgcccaggtcaagcggctcctgcaggcctgcaagctgctctacatggccctgaggacccaggaaggggagggcgcgggtgccgacgagttcctgcctctgctgagcctcgtcttggcccactgtgaccttcctgagctgctgctggaggccgagtacatgtcggagctgctggagcccagcctgcttactggagagggtggctactacctgaccagcctctctgccagcctggccctgctgagtggcctgggtcaggcccacaccctcccactgagccccgtgcaggagctacggcgctccctcagcctctgggagcagcgccgcctgcctgccacccactgcttccagcacctcctccgagtagcctatcaggatcccagcagtggctgcacctccaagaccctggccgtgcccccagaagcctcgattgccaccctgaaccagctctgtgccaccaagttccgagtgacccagcccaacacttttggcctcttcctccaggggaaccagaggcagagggaagccgggcagcagaggagtagcttgaagtggccagaagggtcattcggggcgggagaccctgagcctgctgagaaatccttttagcgccagcaagccccacccagggccctgtcctgtgtctgccaccacctttgtctgatacttgtttccagggaagctgggggaactgccacatctgaggaactggaataaagatgagggggcttcggggg

SEQ ID NO: 5457 - DNA, 2765 bp, Homo sapiens
gcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaaaacaaatgtaaagaatgtcccccctttacctgcattgctggacttctgtgcatgttggatgcaattgtctcacaccaacacgagtgtgtgtgtcaagcttattcattcctgtgtgactgtgcacgcctgctcaacattctcatactctcctgtgtcagcttactagcatcaaaaagccatcctcattccaccaggaagccctcctaaacccagttatagcatctgcttgatgtggatgcagtcatggactgaaaggtaaactggagccatcacatctccccttggaagtccagtgctcagaggaccgccacagagggttccatgtagggcaggctgtgtcaaagtcatacagccaaggtcagaagtcatgcatcctgtcaccattcaaacagcttttgcagccggacatttttcctagattgttagatggtctagctattttactgtggggtaaaacaagttttctgtttccttcttgcccgcacaatcagattttagccttcctgacattgtccatctttatgatcaccaccaacttctgcatccttttcatgcatgtcccagactccctgctttttagttttacacaatcaaagcttacctct

SEQ ID NO: 5458 - DNA, 9808 bp, Homo sapiens
caaccccgccttctgcgtctcggctggacgcgagcacactcggctccgccgccgccgccgccgccgcggggcgctgcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggccagaatggagtctatgaatcggccctacacttcacttgtgccccctttatccccgcaacctaagatagtcaccccctacactgcttcacagccttcaccacctctacctcctccgccacccccacctcctcctccaccaccccctccaccaccccctcctcccccactccccagccagtctgcaccttctgcaggctcagcagccccaatgttcgtcaagtacagcacaataacacggctacagaatgcgtctcagcattcaggggccctgtttaagccgccaacacccccagtgatgcagtcacagtcagtgaagcctcagatcctggtaccccccaatggagttgttccaccaccccctccccctcctccacccccaaccccaggctctgccatggcccagctaaagcctgcaccgtgtgccccatcccttccacagttcagtgccccgcctcctccactgaagatccatcaagttcagcatattactcaggtggctcccccaacaccccccccacctcctcctatccctgcacccctccctccccaagctcccccaaaaccccttgtgaccatccccgcaccaaccagcaccaagactgtggcacctgttgtgactcaagctgcaccacccacacctactcctccagtgcccccagcaaaaaagcagccagctttccctgcttcttacattccaccctctccccctacccctcctgttccagtacccccgccaacattacccaagcaacagagcttctgtgcaaaaccccctccctctccactgtcaccggtgccctcggtcgtgaagcagatagccagccagtttccaccccctccaactccccctgccatggaatctcagcccttaaagcctgtcccagcaaatgtagctccacagtcccctcctgcagtaaaagcaaagcccaagtggcagcccagctccatcccagtcccttctccggacttccctcctccccctcctgaaagcagcctggtgtttcctcctccacccccatcacctgtcccagccccaccaccaccacctccacccacagcttctcctacccctgacaaaagtggatctccaggcaaaaagaccagtaagacgtccagccctgggggaaagaaaccacccccaaccccacagcgcaactccagcattaaatccagcagtggtgcagagcaccccgagcccaagagaccctcggtggacagtctagtcagcaagtttacaccgccagcagaatcagggtctcccagcaaggagaccctaccacctcctgcagcaccccccaagcctggaaaactcaatctttctggagtcaaccttcctggagttctccaacaagggtgtgtgtcagcaaaagcccctgttctgagtgggcgtggaaaggactccgtggtggaatttccttctcctccatccgattctgattttccaccccctccacctgaaacagagcttcctctgccccccattgagattccagcagttttctcgggaaacacctctccaaaagtggcagtcgttaatcctcaaccacaacaatggtctaaaatgtcagtgaagaaggcccctccacccacacgacccaaacggaatgatagcacccgcctcactcaagctgagatttctgagcagccaacaatggccacagttgtgccacaagtgcccacctctcccaaatccagccttagtgtccagcctggattcctggctgacctcaacaggacactgcaacgaaagtccatcactcggcacggctcactctcctcccgcatgtccagagcagaaccaacagccaccatggatgatatggcattgcctccaccaccccctgaactgctgtctgatcaacagaaggctggttacggaggcagtcatatatcaggctatgcaacgttgcggagaggaccccctcctgctccccccaaaagagaccagaacaccaagctctccagagactggtagccaccataggactttattttcatgatatctgtaatcactgctacaatcagctcacctgatcatctgtgaattcaggtgttcagagcctcctggtatgatgttattcaggtagtgtccagctatatgtgtatgtgtgtgtgtacacgtgcatgtacacacagctgtacagtgtgtgtatatatgtatacatatatgtatgtgtatgtgtatatagagagagagctgagagttattctatttattccttttctctcctaatctgaaaatgggtgttctgtattttgggtggaagaggcatagaaggggatgtgtgttgtctcttaagatttctatatcatgtggattggaccaaaaacttctaatcacttatttagaaggtatttataagtgtctgtccatgtgtagcctattcgtgcatgttgtgtattatataactaaggaatagatgtagaatgtgctatttctggttgagaaaaatcaccagaatgtttggtgtatctataaggcttttgtgtttgtttttccccagttggctgaagttagaattgcttgactgacacttcattgctatacatgaaggggcactttaaatcaggaaaatctctcagcttcatagaacgggtaactagtgcaggatggggaaatgttcacagacatcatctgtatgtggttgtgcatagaaagtaaatacatggcgtaattaactcagctgttctagctgcagtactgctgcagtgatccacccacatttaggatgtgctgacagataagctctttgcctacaatacatggataattagtgctataattctggatagttcctttttagtactgttttatgaagctttatcaacttggcttcatgatcctcactttgattgattttaagaggatggataacacagttatctctgtaatgttctgtcccagtatgtctttgggtcaccagttaccttcttaaaatatgtgctttaggtaggtgttattacatatctgtagacaattggtatatgaaatatacacatcctgtgccccaatatggtgcattatgaaaaacaaaatcattttctaaaatgcattttttgagcattgctctatagaagggaagggtgatgagagaacagaactggcccctgtacaggtgtcattaatctggttgtatatgggttataatatgtaatacaaaaagctcattaagtatgggactacatggagagggaagacagtttcatttatagctactggggctaccaggacccttgctgactgcagcctggttgtgattagttcaggttactaggtgttctgatggagtgggacagtccaagtccagtaactgacattacgttttatgcgtgtgcagtttggtataacgtggagtcagtgctctaacgacacactatacttctatatgcttttttctgtgaattttccttggtacatgagagaaataagtactctcatcaacttatgataaattggactattaggaataaaacaatctcagagcagctcctaaacaagagaataaaaatgggccatcccagcacttataaggggagcacatcttgtaatgaaagtctgtgcctattgttaatgattaccaatgcaaactgcagaaatcagttgacattgtcccacaaggaaaaagtgatgccagtaaagtgggggaagagatggtaaataattctagaatgagcaaaagtgcttaattagtacagtatactcaaggtcttgcataacccacactccacgaaaaccgcatcgtaaacagagagtgaacagcacctctccattgctacatctccagaatattgttcggttatgttcatgtggttatggagcaataagaatatataccattaatttttaggtctttcaaattgttcaccaagttttgtgtttgatatttatgaagtgatctttaacacatctgcattgttaatttaagcatgcacagaaatttgggtaatgtttgagtagattgccaagcgctactgtgattcatgaatgaatttctcatagtcttctgcctgcagttttatagtttgaggggcacccatatttgtgggttagagttagtaagaatatgaatccagttatcaaagtattcatccctgaggttttgagttttattgtggtggtgattttctcatgagaaggtagacaacacttcagtttttcttgagggggaaaaaatgtacccgctaaccttttttcacccatgatttgagccctaaaacaacagcctttatgttttcagtgcaggatttcttggaatttcttgcttgtatcaatcctgatgatagccatcctgaacagatgcttctggtctgttttcctggaatagcagacatccttttgaacactaatgatgccaggaagagagtaaggctagaggaggagactcattttaaccccagtccagtggcttgtccgacaacaggccatttccctttacattcctccacagacagaaatggctattaaaaatgttttaacctcatgtatgaactgaatttaaaaaaccactaaagtgatactttatacttctgttttactccctagtgggttttctttaatttggatttttgttgggatgtagcttttcctagactgtatttctgtagctctttttctctggtgtattcatggaaagcatctactgccgcacgacactagtactgtgccttctttcactgccctctgctctgcagctctcacccagcttggctgcttcaagtctgtgcagttgacttggctgtactgaaaagtgaacagcatggattaactcatcctgctgctgagggcagtgcaaacaggtgcttattagaggtagtgacttgcttaattagtgacactcctaatttctactatggataatttcaaagtagaatcactctatgcttagagttttggcaccaatgctgtagggcagcagaatctattctcagtaaaataacttatggtttattagatattctgtattggattttaccagcttgacttttactgctcagatgctttctttcccccccttagacgctgtaattctcttgggaagagtaactattcttaaggtttttacagatacccaccttagttgtaaattggatagtttatatttctgggactttttaaatgaaaatgtggaatgttaagttacaaaagacttttcatcagaaaatttcaaacaaagtaaacatggcgttttatagtcctctaaaatctaggtgctcccacccaccaaaggcatatcctgcaaagggctgtgaactatcttggtgaactgtcttgggtcccctttccatgtatgttttcttgtcactgaaaacaaacaacgctgagtttatcaagaaaatttaaattgggggatcataataattccaaccaagtgacaactctgacatcaaggttattaggagctgtacatccaattcaagttttatttgctgctattctgggagaataaacttgtatatggagaataaactaataaacttgtatcgaggaaatccataaagttataaattagcctgaaaaatatttcaggtaatggtgtggattggcctgctttgactctcagccaccaacagaaatctttgtcacctttgttcctcagctaaaagtaattttgttataaacacaaagtgactttaaacaggtaaaaaacccattcctatttttgtacattaccaaaagtttttcatatacctacagagctaactaattacaactgatttaatccactcaagtttagaccagttaaacccataggatcctgtatggttatcaatgtgatgccttgcttttcataaaataggtataattgggtcatacacttgacgagagggtgactgtttctaggggaagaaaaccctttagattgcaggtaactttcacttttttttttttaatatacactttacatttgtataaattatgcagggtactcctaaccctgtagaaatgtatgacctctcacaaagttgagatttgatccaaagagaaatgcaagtataaaagaattagatacttattatcttttaaggtttttttttttttttggtagagatgggggtctcactgtgttgcccaggctggtctcaaactcctggccacaagtgatcttcctgcctcagcctcccaaaatgctgagattacaggcatgagccactgtacccagcctttccttataaaattcaaagagaaaatttctacacctttatccctcaaataaaacaagtgctcagttcttaccgtgcccttgcaaggtctatatgtaaaagaaatctgaaatttagctgtagaataaaacttgataaataaaaagaaaaaacatacatttctccagttggtttgctctttgcttgttgaagtaataaaccgttttaaagagaaaatacttgctgtaaacccccagtgccttcaactcttttggcagaatatttttaaagaaatccagcaagcaaactttgaggtgctaatgaaagtaaaggaaggtggtatttctagttttggcagaaatgaaaagtgtctcacaagagacatcactacccacgtggggtctggctgctttctaccaaagacatttagagaagtgaattgagtcagggtgatggtgaacactacatattttatagatggttaagttgagaattaattatgtttatcatggatggctactaataccaagctcatgattgttgcagcctcaacgtcttaggcagtaaaacttgtctgcagcactaaagggggagaaacccttatattttgcaaactgtccattcgttaaatttattgtaacctaataccaaaaactgccgtttttcatattatttccccacctcctacttttttttttttttttgctacttgtaaaataaccccttctagaaaataagcattaactggaatgtttcaaacaattttgcttcattttactatcagccactagtgaactcttacagagatgtacatttaagataaaattagcttgtgctaagtgttttaaaaacattgtttactgttaaaggggaattgcacattatatttaactgggattgctccctccctcagttctttaaaaaacaagagtcaaggctcacaccaacttgtaggctgtgggagctttgccataggtagatacaatgtagaagtatacttttttaaagcatgaagaagacaaggaacttcattataatgtaccaggtagaggacattattattcaaaggattatgcacagctcagtgaagatgaagttacaatttttctcgcagctttgttgctattattttcttctgcataaatgtatgctcatttcattatgtgccttgctccctgattgtgcaaagctatatatatatatatatatatatagatagatagatagatatatgagagagatatattcagtactactgaggatgtttttctgaggatgtttttgttctgctggattaagttattttccaagttactcttgccagttatgtcagtaaactattgtaatggcttagcacactagtcgtacagtcagtgtaaatgtttttcatttacatgttttcattatatcagcttatcaaatccttaataaaaaaaattcatagatttcatttaaacatggggactttgagtgtttgtggatcggcaccattaagaatctggttttgcatttcatgtcagggtacccaaaacataggccatacacagaagaaattaagtgtggtaaataaactagtttgatatgttcaa

SEQ ID NO: 5459 - DNA, 2686 bp, Homo sapiens
gcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaaaacaaatgtaaagaatgtcccccctttacctgcattgctggacttctgtgcatgttggatgcaattgtctcacaccaacacgagtgtgtgtgtcaagcttattcattcctgtgtgactgtgcacgcctgctcaacattctcatactctcctgtgtcagcttactagcatcaaaaagccatcctcattccaccaggaagccctcctaaacccagttatagcatctgcttgatgtggatgcagtcatggactgaaaggtaaactggagccatcacatctccccttggaagtccagtgctcagaggaccgccacagagggttccatgtagggcaggctgtgtcaaagtcatacagccaaggtcagaagtcatgcatcctgtcaccattcaaacagcttttgcagccggacatttttcctagattgttagatggtctagctattttactgtggggtaaaacaagttttctgtttccttcttgcccgcacaatcagattttagccttcctgacattgtccatctttatgatcaccaccaacttctgcatccttttcatgcatgtcccagactccctgctttttagttttacacaatcaaagcttacctctgt

SEQ ID NO: 5460 - DNA, 2692 bp, Homo sapiens
gcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctgaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaaaacaaatgtaaagaatgtcccccctttacctgcattgctggacttctgtgcatgttggatgcaattgtctcacaccaacacgagtgtgtgtgtcaagcttattcattcctgtgtgactgtgcacgcctgctcaacattctcatactctcctgtgtcagcttactagcatcaaaaagccatcctcattccaccaggaagccctcctaaacccagttatagcatctgcttgatgtggatgcagtcatggactgaaaggtaaactggagccatcacatctccccttggaagtccagtgctcagaggaccgccacagagggttccatgtagggcaggctgtgtcaaagtcatacagccaaggtcagaagtcatgcatcctgtcaccattcaaacagcttttgcagccggacatttttcctagattgttagatggtctagctattttactgtggggtaaaacaagttttctgtttccttcttgcccgcacaatcagattttagccttcctgacattgtccatctttatgatcaccaccaacttctgcatccttttcatgcatgtcccagactccctgctttttagttttacacaatcaaagcttacctctgt

SEQ ID NO: 5461 - DNA, 3909 bp, Homo sapiens
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggccagaatggagtctatgaatcggccctacacttcacttgtgccccctttatccccgcaacctaagatagtcaccccctacactgcttcacagccttcaccacctctacctcctccgccacccccacctcctcctccaccaccccctccaccaccccctcctcccccactccccagccagtctgcaccttctgcaggctcagcagccccaatgttcgtcaagtacagcacaataacacggctacagaatgcgtctcagcattcaggggccctgtttaagccgccaacacccccagtgatgcagtcacagtcagtgaagcctcagatcctggtaccccccaatggagttgttccaccaccccctccccctcctccacccccaaccccaggctctgccatggcccagctaaagcctgcaccgtgtgccccatcccttccacagttcagtgccccgcctcctccactgaagatccatcaagttcagcatattactcaggtggctcccccaacaccccccccacctcctcctatccctgcacccctccctccccaagctcccccaaaaccccttgtgaccatccccgcaccaaccagcaccaagactgtggcacctgttgtgactcaagctgcaccacccacacctactcctccagtgcccccagcaaaaaagcagccagctttccctgcttcttacattccaccctctccccctacccctcctgttccagtacccccgccaacattacccaagcaacagagcttctgtgcaaaaccccctccctctccactgtcaccggtgccctcggtcgtgaagcagatagccagccagtttccaccccctccaactccccctgccatggaatctcagcccttaaagcctgtcccagcaaatgtagctccacagtcccctcctgcagtaaaagcaaagcccaagtggcagcccagctccatcccagtcccttctccggacttccctcctccccctcctgaaagcagcctggtgtttcctcctccacccccatcacctgtcccagccccaccaccaccacctccacccacagcttctcctacccctgacaaaagtggatctccaggcaaaaagaccagtaagacgtccagccctgggggaaagaaaccacccccaaccccacagcgcaactccagcattaaatccagcagtggtgcagagcaccccgagcccaagagaccctcggtggacagtctagtcagcaagtttacaccgccagcagaatcagggtctcccagcaaggagaccctaccacctcctgcagcaccccccaagcctggaaaactcaatctttctggagtcaaccttcctggagttctccaacaagggtgtgtgtcagcaaaagcccctgttctgagtgggcgtggaaaggactccgtggtggaatttccttctcctccatccgattctgattttccaccccctccacctgaaacagagcttcctctgccccccattgagattccagcagttttctcgggaaacacctctccaaaagtggcagtcgttaatcctcaaccacaacaatggtctaaaatgtcagtgaagaaggcccctccacccacacgacccaaacggaatgatagcacccgcctcactcaagctgagatttctgagcagccaacaatggccacagttgtgccacaagtgcccacctctcccaaatccagccttagtgtccagcctggattcctggctgacctcaacaggacactgcaacgaaagtccatcactcggcacggctcactctcctcccgcatgtccagagcagaaccaacagccaccatggatgatatggcattgcctccaccaccccctgaactgctgtctgatcaacagaaggctggttacggaggcagtcatatatcaggctatgcaacgttgcggagaggaccccctcctgctccccccaaaagagaccagaacaccaagctctccagagactggtag

SEQ ID NO: 5462 - DNA, 1875 bp, Homo sapiens
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctgaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggtaacagcttcgttttaa

SEQ ID NO: 5463 - DNA, 1794 bp, Homo sapiens
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggtaacagcttcgttttaa

SEQ ID NO: 5464 - DNA, 1779 bp, Homo sapiens
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaa

SEQ ID NO: 5465 - DNA, 492 bp, Homo sapiens
gcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgctctgaatcagggagagactgtggatctggatgccttgatg

SEQ ID NO: 5466 - DNA, 1860 bp, Homo sapiens
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctgaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaa

SEQ ID NO: 5467 - DNA, 585 bp, Homo sapiens
aaagattgtctccgttattttgctttttgtgtggtgaatttcccagaaaccagatgcagccctactcaaatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcag

SEQ ID NO: 5468 - DNA, 1869 bp, Homo sapiens
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggtaacagcttcgttttaa

SEQ ID NO: 5469 - DNA, 1854 bp, Homo sapiens
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaa

SEQ ID NO: 5470 - DNA, 2394 bp, Homo sapiens
gcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggtaacagcttcgttttaatttacattgaaaattctgtggtattcttttgggtttaaattgttgctctcttatgtctttatcggggatcttatttggccttatttcagtctcctttattaattttcaatcttcctaattgtagtgggtaaagacagttcagagagacctgttgatttgacttccccttggaaatgagtattttacaaattggctctaatgacttaaaatctcaaaaaa

SEQ ID NO: 5471 - DNA, 4738 bp, Homo sapiens
atttagccaaacaacctttaattcattgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactaactatgaactatttatttcctcctcccctacccctagttaagtgccacaaagactgtgttatgtagtcagtacttttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagacgtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgtatatacatatataaattaca

SEQ ID NO: 5472 - DNA, 4807 bp, Homo sapiens
acagagcaacttccacctgctgtgcgagttggtgatcctctctcttgccgttcgagagccccagtgaaacttgagtgagatgagagagcatggagcctgccagtctccccctctgcgcacacacacacgcaaacacatttaactttccacttgcagtgacctgcccttcagtgtgacttatcagctgtttggcttttgtcactaaaggaaaacaaattgtggaatatcccgctctgcatgctcatgagatggctgagccaactcaggggttatgaggtggtttgcgagtgaggagaagaatgatcttcagtttctgacctcctggcacggtggcgggcggtatttatcaggaggtacatgtgactggttaagactcagagccccagcttgaaggaaacagctgctctcggcgtgctccggcacttggcagctggacaggcagagtgctgatgtgaaaaataccacgacaaaaccaccctagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactaactatgaactatttatttcctcctcccctacccctagttaagtgccacaaagactgtgttatgtagtcagtacttttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagacgtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgta

SEQ ID NO: 5473 - DNA, 4210 bp, Homo sapiens
gataccctttacactagattagcaggcaaaactatgatggtttgtgatatccatgcttgtagaagtaataagaagaaagggaacacagaagctttattttatagtggagtcctgactctaggccttaataattgcatggttttggagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactaactatgaactatttatttcctcctcccctacccctagttaagtgccacaaagactgtgttatgtagtcagtacttttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagacgtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaagg

SEQ ID NO: 5474 - DNA, 557 bp, Homo sapiens
acttggcagctggacaggcagagtgctgatgtgaaaaataccacgacaaaaccaccctaatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaac

SEQ ID NO: 5475 - DNA, 540 bp, Homo sapiens
acttggcagctggacaggcagagtgctgatgtgaaaaataccacgacaaaaccaccctagtgttcatttcactgggcaggttgtctaccagaaccaaggggcctctttgaattttctttcaagctattaataagaggcatgcatcctcctagacacaatcatccatttagtaaaataggttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttg

SEQ ID NO: 5476 - DNA, 861 bp, Homo sapiens
gaaatagctgtctatcacaggcagctaggaactgcttgcccacttttttttgttctgaaagaaaggatacagaccatctgggccagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctca

SEQ ID NO: 5477 - DNA, 596 bp, Homo sapiens
aacagctgctctcggcgtgctccggcacttggcagctggacaggcagagtgctgatgtgaaaaataccacgacaaaaccaccctaatggagtttcactctgtcgcccaggctggagtgcagtggcacgatctcggctcactgcaagctccgcctcccgggttcacaccattcttctgcctcagcctcccgagtagctgggactacagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttc

SEQ ID NO: 5478 - DNA, 554 bp, Homo sapiens
acttggcagctggacaggcagagtgctgatgtgaaaaataccacgacaaaaccaccctaatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaa

SEQ ID NO: 5479 - DNA, 1210 bp, Homo sapiens
cggcgcggcgcggctcagtagttccccgggcgcccggctccctggcgttagacgtgctgtgttgtgatcacgtgggcagctccgggcgcggcgcttgttttggtttccttctaacttgcccacggcagcttcggggtgagcgactttcctgcaccagctgccgcgcctgctcacaccctgacctcgttttcgggctctctgagcccgcagttccgcaagcccctggggcgggctcctgccatgccgctagtccgctacaggaaggtggtcatcctcggataccgctgtgtagggaagacatctttggcacatcaatttgtggaaggcgagttctcggaaggctacgatcctacagtggagaatacttacagcaagatagtgactcttggcaaagatgagtttcacctacatctggtggacacagcagggcaggatgagtacagcattctgccctattcattcatcattggggtccatggttatgtgcttgtgtattctgtcacctctctgcatagcttccaagtcattgagagtctgtaccaaaagctacatgaaggccatgggaaaacccgggtgccagtggttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggtgttggctgggtaaggggagccggggacttctgaaatagagctggctccctggggtgacaatgtatatatgcaaataaattgagaaatcttt

SEQ ID NO: 5480 - DNA, 1129 bp, Homo sapiens
attcctgccccgccgggcctgccccgcgcagtctgggtctctgcgccgcagccgcccgcccgcccgctcagcgcccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgagagctacacccccacggtgtttgagcggtacatggtcaacctgcaagtgaaaggcaaacctgtgcacctccacatctgggacacagcagggcaagatgactatgaccgcctgcggcccctgttctaccctgacgccagcgtcctgctgctttgcttcgatgtcaccagcccgaacagctttgacaacatctttaaccggtggtacccagaagtgaatcatttctgcaagaaggtacccatcatcgtcgtgggctgcaagactgacctgtgcaaggacaaatcactggtgaacaagctccgaagaaacggattggagcctgtgacctaccacaggggccaggagatggcgaggtccgtgggcgcggtggcctacctcgagtgctcggctcggctccatgacaacgtccacgccgtcttccaggaggccgccgaggtggccctcagcagccgcggtcgcaacttctggcggcggattacccagggcttttgcgtggtgacctgagcggctcggggcgtcccagcgacgcgggaaggggcagggcgctgacctgctgctgagctggctgggctggacccggtccctaggctgtgaccgccgaactccactgcaacagacgggcgccaccaaagccaggccctgaggcctgggagtcctggactgagaaagggggttcctgggcccacctgctctgtgtagggctcgtcctgcggtgcccgagaatcactcgctaacccctatgcccggtcccggaccgacatcctggagccgcctgtgcagcctgatgccccctcgtggctgctcccagggctgcacctgccaggacctaatgttcttaggtccctctggccagaacccacacccggccccttcccacctgtcatactggtaactgtaacaagaaaaacgacatca

SEQ ID NO: 5481 - DNA, 3005 bp, Homo sapiens
gtgcacgctggcgtccctggcccaggcgaggtgggcagacatgactctcgcgtcagcatcttccctggtgccaccgccgctacctcctgtggggaagctgaggccagaggcggacatgtgccaagccacaccgctggggcagtgcaaagttgaggggctcttcccggagctggaggccgggggcttctcgaacccggtgcggaggcacagccagccaatccgggagaccctgtctggccgcgccagccaatcagagggtccctgccgaaggcggagcctgctaatcaggggcacctggagtcgctgggcagccacgatcgggtctcgccggcgaggggcgcgacgtgacgcgcggagggtggcggtgggttgggggtgggagctttgctcgcagctgagccccgtttttccggtgctgcagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccggcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaacgtagacctggcactgttccacgcgggcgccccaagcctgccactcctgtgtccctgcctccctgggctcccgagataggcaccactgtatcctccagctccttccttccttcccccaggaacacggaggccaccgagggggctgggcctatcaggaggacacaggctgcagcctggcacccacccctcccatctccaccccacatggaagacttgtcttcaacttggccactgtctttgcagagctgggcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagttttctgtggactgttccccccactgtggtaggacaggactggcccacttagtcctcaagctcccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaatttttttttttttttttttttgggacagagtctcattctgtcactcaggctagagtgcagtggcatgatcttggctcactgcaagctccacctcctgggttcaagcgattctcttgcctcagcctcctgagtagctgggactacatgcgcacaccaccacgtccggctaatttttgtatttttagtagagacagggtttcaccatgttggccaggctggtcttgaactcctgacctcgtgatccacccgccttagcctcccaaagtgctgggattacaggcgtgagccaccgtgcccggcccaggacttttaaaacaagcatcccaggggattccggtgcctaccagaagtcgcaagctgcttggctctggagggcgcctaggagtcggtgtcgcctaagatgggataatggcttcaggcaactcctagccttccccatatctcctgcctcagcccccctggcccagtgctggggcgtcagctaaacctgagcttccaagaagtcaggttgccaaaggaaggagccttctgagaccctccccaacccacccaggttcccaaggccctgccgtaccctggggaatcaaccaaggagttcttgttctcgaagaaccccaggcctcatgatggtctacggtagaggtccaacaactacagcctgtgggccacatctggccacagcctgatttgtaaataaagttttattggaacaca

SEQ ID NO: 5482 - DNA, 670 bp, Homo sapiens
ggcgattgcccggcagagggcgtcagacgtccaccctgcagcccagggtcggggtgcgggtaagcggagcccagtccctcaccccgaacccgcgtgcacgctggcgtccctggcccaggcgagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccggcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaaggtg

SEQ ID NO: 5483 - DNA, 1319 bp, Homo sapiens
cacttcctccggcctcccgctctcacttccttctcgagcccggagccgctgccgccgcccccagctcccccgcctcggggagggcaccaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtg

SEQ ID NO: 5484 - DNA, 1066 bp, Homo sapiens
ccggcccaggactcggcgcgggcgccggctcatgagtttgctggcggaggccgcgggcgggagcttctcggttcagtccaagtagggcgggcgcggccggccgggcggggcgggaacggggccactgcgagccggcggaggctcggcgagggtggcttcccggcggctgtaccgcctctagggagccgagagggacccctgaggtcggagggtcccgggctccaagataagtgtctctgaagtggaagagctcagagctgggagatcggacgcaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttt

SEQ ID NO: 5485 - DNA, 1289 bp, Homo sapiens
catgaatgcaccaggatgggctaggcatgagagcctgggaacttggaagcaaaaaggctcagatgtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctcc

SEQ ID NO: 5486 - DNA, 886 bp, Homo sapiens
cagggtcttgctctgtcgcacaggctggagtgcagtggtgtgatcatagcccactgcagccttgaccaccctgggatcaagtgatgctcccacctcagcctcccgagtagctgggactacaggtgtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttcc

SEQ ID NO: 5487 - DNA, 1999 bp, Homo sapiens
tattctaatggagagaaacgcacgtgcacacacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttac

SEQ ID NO: 5488 - DNA, 789 bp, Homo sapiens
agaggcgtgtaggtcaggagcaggaggaagcccaacgctggactgtaccagatcatctaaaactggcaattccaggcacagaaaaccagttcttcagaagcagaagggtggtcagccagggggtgaaagggacaggggtctcgcagccagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattagg

SEQ ID NO: 5489 - DNA, 1225 bp, Homo sapiens
agtttgagaagaagcagtgatcaccttcttcttcactcttcacgctgatgaatttctacatcactgtgcatgtcctgtgctttgcagtcattccctaggagctcgggcccttgacccaaagatactgctcttactaacactacattttaaactcctcctctggactcactctcagagcctgccgcacaatctttaaaaactttgtcaatgattgcaaaatctttttccttttagagtggatttgattttaggagacagccattcggagctacatccagtgaataagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatg

SEQ ID NO: 5490 - DNA, 814 bp, Homo sapiens
aagtgtttaccataaagggcagctgtgaggctgtgagatgggagaatcaatctatttattggtcagaaagtggttgttcagtaccttggatttctgagtgggcaaggctggaccctgagccctgggacctctgaagtgaacactgcagggccatttgtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacc

SEQ ID NO: 5491 - DNA, 874 bp, Homo sapiens
tgtgaggctgtgagatgggagaatcaatctatttattggtcagaaagtggttgttcagtaccttggatttctgagtgggcaaggctggaccctgagccctgggacctctgaagtgaacactgcagggccatttgttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagttttatctacatacaggaaagtgaacaccacgtgggtatacagcttggtggattttcacaaactgcacacacttgtggaaccagcatccagatcaggaagcaacagatgtcctttaaaacatcaagaactgggccggacatggtggctcacgcctgtaatcccagcactttgggaggccaagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtgggg

SEQ ID NO: 5492 - DNA, 571 bp, Homo sapiens
actgtggaatagtggtttctaaagctggctggacagcaaaaccacctggggagcttttaagaaactgaaattccatgtctcataccccagccctcacgtgaggtccaggaatctgtgtgattaaaaaatacaagccccaaaacaacttggaaagtggtcgttttgcaggtggggatttaggaaccaagaatccagaactctcctaccagggccccagaaacctttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagt

SEQ ID NO: 5493 - DNA, 3302 bp, Homo sapiens
cggcaagctggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccaggaggaatgggtccccgagctcaaggactgcatgcctcacgtgccttatgtcctcatagggacccagattgatctccgtgatgacccaaaaaccttggcccgtttgctgtatatgaaagagaaacctctcacttacgagcatggtgtgaagctcgcaaaagcgatcggagcacagtgctacttggaatgttcagctctgactcagaaaggtctcaaagcggtttttgatgaagcaatcctcaccattttccaccccaagaaaaagaagaaacgctgttctgagggtcacagctgctgttcaattatctgaggttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcagcccactgccacgacctccctgccagccagaagcatccgtactgcacgctgtctgagaatgctgggcctggattgcagacagtgccgctgctgatcgcatcaaaaacaaagtcaaaggccatctcacattttacaaatccccagctcatgaacgtgaagctgataggaaatcaccccagggaacccgaaaaagaaacttgattcctctattgctggccttacttgatgtcttttataaaacttgggactacaatactaacctttttttctgaatctgctgttctacccatgtgtctcacattcatttgtattatttcaagaaatgtactaatttccagttcactcaggccttactaatccataccaaattagcctaaagacaaggcattttatattcatttctattttcagcatgtttctaccaaagctattagaaccaacacgtacctctgaatgcccgattataagaagacatgagaagactttaaaagttttggaaatttacagagccatgatttttgaacctaattgaaagaaaaccatctgaattgttgcaggtccacatttttgccaaagatacactctatagatgcttagtagtggcctgatttttttccatgtattgccacgacaaactaaaaatgaactgtgtttaagaatgtagtatttctgtttttcatccaagttgattgggggaagaatatggcaggatccatcttttacagtattttgtattcagtaaagtggacattcctgctcctcccttcccccattgcatgccctcttcctcccttgatttcactttctctcatgcccggatccttttattctccccagttataacccagttataaaagaaagatctgagcataaagatacgtgtttaaaaataactaaaagtaaaggaaagtgccttaatttttctatttgcttcaactgaaagtgcttctcagctcgccccatgtaagttctcattccatgtaaatgacattttccagttacaactggtactgagattttgcctctctctttccttactcatcctcccaaatgtctttgtgggagccatatcagtggataccaagctctgtatccatttgtcccctgccctccacaatgtgtgacatagaacagggactttggccctgggaaagcaaaagctcccagtaaggaatcctgtgcccaatgatgtaaaacaattccaaacatccaggaatttttgtatcatagagcgaattacttcctatcttttcattagaggctatgaggacttctaattagtcttagttgcttataagtgccctggaatcacccaggtaggcacttaatttttttttcagttgcatgagcaaagtgcttcttagtagtgtgaaattacaacaactttaagactttccagattcaagctcccactgttggaaaaagccagcctttctaatctcttctgctactggaataagcacttaagaattgcgtgatagccaggcaccgtggctcatgcctgtaatcccaacacttagggaggctgaggtgggtgggccgcttgagctcaggagttcaagaccagcctgggtaatatagtgagatcctgtgtctctataaaaaaattaaaaattagtcagttgtagtgacacatacctgtagtcccagctactcaggaggctgaggtggaaggatcacttgagcccagaaggtaaggctgcagtgagctgtgactgtgccactacactccagcctgagtgacagagaaagaacctgtcaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggca

SEQ ID NO: 5494 - DNA, 2975 bp, Homo sapiens
ccggtcttatgatccggcggatcctcctggggaggccgggccggggagagggcgcgggcgccgagtggcgggggcagcgggcgggcgcggcgaccggggccggggcggggatccgggcggcgaccgcggcggcggcagcgccccgggcccgccgccccctcccctcctgcgaggggagccgctgcatggggccgggggggcggccctgcggcgcggagcggcggcgacggcggcggaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 5495 - DNA, 1705 bp, Homo sapiens
gggcggggccctacacaaacccgctggtagcgctgggccgactcgcccagcctggacccattcagtcagaggcagccagcgggacctgcttcaccgagcgcagcgaagccgagacccgggctggcccctctgctgcccccggagcgggccatgccgccgcgggagctgagcgaggccgagccgcccccgctccgggccccgacccctcccccgcggcggcgtagcgcgcccccagagctgggcatcaagtgcgtgctggtgggcgacggcgccgtgggcaagagcagcctcatcgtcagctacacctgcaatgggtaccccgcgcgctaccggcccactgcgctggacaccttctctgtgcaagtcctggtggatggagctccggtgcgcattgagctctgggacacagcgggacaggaggattttgaccgacttcgttccctttgctacccggataccgatgtcttcctggcgtgcttcagcgtggtgcagcccagctcctttcaaaacatcacagagaaatggctgcccgagatccgcacgcacaacccccaggcgcctgtgctgctggtgggcacccaggccgacctgagggacgatgtcaacgtactaattcagctggaccaggggggccgggagggccccgtgccccaaccccaggctcagggtctggccgagaagatccgagcctgctgctaccttgagtgctcagccttgacgcagaagaacttgaaggaagtatttgactcggctattctcagtgccattgagcacaaagcccggctggagaagaaactgaatgccaaaggtgtgcgcaccctctcccgctgccgctggaagaagttcttctgcttcgtttgagcagctatggctgcatagcaagtagtaggcaggaggccaaagacttctgagacctggggcacccgggcctttgcggcagctactggcagggcctggccacctcataggactcagttcccttctgaacactcgggggacatgggcctctaactgcccactctgatatgcctgggtgagcctaggagggaaggctctgatttggatttctccagtcaaagctcacagaaaaaaacctggcactttgattttcatgggatggtcctaacagggtcagtcacctccgagcagtttgggaacccagtttcttgtcctgggccctcaggtcagcctggctgaattaggacccttccttggcacaggggtgagaaagagcttggggaacgcttggcattatggagggctggaaggggctcaaccccgatttggagagaagtttgggatggagtgggcgagagattgagagagcgagcaggaaaagaggtcttggagcctgggactgatggtggataaggcctggaaagaagatgacgaggaggaggagagagggaagtggggtggatgaggagcaggctgacacctgggctgccctcaatccccaaggccagggagggcggggctggcccctgggaagaactgggtctctgggctccctaggcactgcccaaactggctgagccaggagtggggcaggaagtgagagtcaaggcccagcaaaaggagggggaggagctgcaaattagaacctgaaggaggaccgggttggggatcatccctttcctcaaggtcacacagcctagaagctagagcagtgcagagtctgcaaataaaaccttaagtctgtgaa

SEQ ID NO: 5496 - DNA, 2385 bp, Homo sapiens
agaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggtcataaatggagatgagattattcaaacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagatt

SEQ ID NO: 5497 - DNA, 4378 bp, Homo sapiens
gaagaaggcggctccgaggaggtgggagggcgagcctcccctcccgggttcttctgcgtcctctcccgggagggacccacacacacctgagcccggacccacccttggtcggggccacgctggatcctcctcccggcctgggtcccgcccgccgactgcaggtgggctgcatcgcccgagcctcgggcagtgggcgacggggaaggaggtgagaggtgtccgcgccggctgccgctcgggtccctgccctcgctgcgcgctctcctcctccccttaccgcaggcagggcgcggagccgcgcgccagcccgccccgaagccgccgcctcgtccccctcccgcctcggggcaccatggagctctctccgtcgtccggaggagccgcggaggcgctgtcctggccggagatgttcccggcgctggagtccgactcgccgctgcccccggaggacctggacgcggttgtcccagtcagtggagccgtcgccggtggcatgttggatcggatccttctggagtccgtgtgccagcaacagagctgggtccgggtgtacgatgtgaaaggaccacccacccaccgtctgtcttgtggtcagtcaccctacaccgagacaacaacgtgggagcggaagtattgcatcctcacagacagccagttggtattgctcaacaaggagaaggagatacctgtggaagggggacaggagcagcagacagattccaccaaagggcgatgcctgaggagaactgtcagtgtcccttccgagggtcagtttcccgagtacccaccagagggcgccactaaactggaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggttacctacttaagtggaagtaaatgcttcagctgtaattctgcttctgagagagacaagtggatggaaaaccttcgcaggacagttcaacctaataaggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaat

SEQ ID NO: 5498 - DNA, 2385 bp, Homo sapiens; identical to SEQ ID NO: 5496

SEQ ID NO: 5499 - DNA, 10898 bp, Homo sapiens
ccctcgattgcttcagcctatcaccctgggatgccgcctgccgctgccgccgccgccgccgccgccaccgccaccgccaccgccaccgccaccgccgtggctgccgggtttgtgggatccgccgcggagcaggagccagagctgtggccggagctgtggcctgagagtcagggggcgggcaggctcattccagaagtgggggccgaggacaggcgggctagaacccggggccaccgccccctacccctcctcaggctgagggaacgggcactcggagcttctgaggcggcggcggcgggagccggtcagagggggcggcccctggcggcgacgcccccaagcccagccctgcccggccccgctccatccccagccagagcctggtctgaccgcgagagacgccggcggggctgaagaaggcggctccgaggaggtgggagggcgagcctcccctcccgggttcttctgcgtcctctcccgggagggacccacacacacctgagcccggacccacccttggtcggggccacgctggatcctcctcccggcctgggtcccgcccgccgactgcaggtgggctgcatcgcccgagcctcgggcagtgggcgacggggaaggaggtgagaggtgtccgcgccggctgccgctcgggtccctgccctcgctgcgcgctctcctcctccccttaccgcaggcagggcgcggagccgcgcgccagcccgccccgaagccgccgcctcgtccccctcccgcctcggggcaccatggagctctctccgtcgtccggaggagccgcggaggcgctgtcctggccggagatgttcccggcgctggagtccgactcgccgctgcccccggaggacctggacgcggttgtcccagtcagtggagccgtcgccggtggcatgttggatcggatccttctggagtccgtgtgccagcaacagagctgggtccgggtgtacgatgtgaaaggaccacccacccaccgtctgtcttgtggtcagtcaccctacaccgagacaacaacgtgggagcggaagtattgcatcctcacagacagccagttggtattgctcaacaaggagaaggagatacctgtggaagggggacaggagcagcagacagattccaccaaagggcgatgcctgaggagaactgtcagtgtcccttccgagggtcagtttcccgagtacccaccagagggcgccactaaactggaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggttacctacttaagtggaagtaaatgcttcagctgtaattctgcttctgagagagacaagtggatggaaaaccttcgcaggacagttcaacctaataaggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgtgtctccacataccatcttcatcttcacacattcactgtgctttcctccccatagtgggagctgtcatcaccaacagggtttactctcccctggagaggttatttaaatagctgtccataagccatccagatcaacaccctttcttccatacagaaaagggctaaccataccacagctggaatctctgaatatttcctattaaaaattttttctatgtgttgttataatttttgtttgggataaagactctatccattgtactagcaaatctatggggggtaattttatctccatctttaacttttaaagtacttcttccccttatcccctcaataaagaaaggaaatccaaatttgaagcatcactctcttaaaagaaaaagaaaataatggaaagtgtcaggatggcacattccagttattattccaatgctcgtagatctgacaataatgacccaatttcaacacttgtcatccatagccttattattatagaacagaaaaagtcatggaaacgaattcatttccttttttccagaggtgtgcaatgtcatcttgaatgcaaccttgattaccagaagtatggaaggttacatgttaaacagacattatatatacaaatatatatataatatatattcacacatatgtacatataactgcacaaataggaaaagttcatgccttctatgctgttcagatataatgttaaaagggtctcaaacctctttaagcaagatctaagtagttgttttatattgagaaagcaacaatgtttctcgaataagttgatgttgattttaaattataagctttaaagaattttttttctagaaaaaggggatggaaaaaaaaggacctgagggagccatatgcatcaagtgagtgtttctccataacagaatatttataagagaacatgtatagtgccctcttttgagtgatgccgacagacaccaagccctccttttcaccaagtcccaggcttgcattccagcctcttgagctctgccctctctcaggtggatctttgtgttggaccttacgtttcagcaacctcaccatggccacataacccacaaccttttaaaacagtttctttcatagcaatccctgtttctgccagacagatctaaaatgggagtttctcactgtgtttatctgatctgcacactttatatccagctgttttggcacttttacgttttcttcacctttggttttggtttgcaaattcttacaccttctctccaagcggagggcacactgtggtcaaaatcacttattttattaggaaaaagaggtaactgttccaaagtgtagtgtcctttgttgaaggaggagggatgtaagcatagatttgttcttgtttctggctattctcagctcaagccatgtttaattcattctttgtaaaagccttcaattgtgccacagaaaacctggtaagagaattgtcagtttcattggccataagtatgtaatgtgggtgatgtcttgccattgaggtttggaagctcttaagtgccgattatggattacagagggctgataaaattacttatattgggaattgagagaagccccaaaaaatcaaatgtgcttttgatggatagagtgtatcttattagcattatgggagctccttagagggctgtcttcactgaaagatttaatgcccaaaacatttggacagattatgcagccttctactaccaggttatcttgaatgaagaagaaatagtaaaaaataataataatagagcattaccaataagctaaaagttcagagttgctgatagatgttaaatgttaagttatcctgtgagcctactcctgtccaaccttttttctcagtatttctttagagaatgctgcaatctgtataagttactctgaaggattttttaagaagagaagccaccaacaggtgataatttttatggagatgtttcttaattggctttccctcagttcaagtaggtaaataactttgtttgctgggaggaggtacatggctgaagagaggcaaatagattaagatagcaatgtcttgcacttcctgtttccctcaaaacaacaccacattgtggggcgcaggatagatcagggttgagtggaatttggaattcaggtgaagtgcttgtaaagtgcatgtctagctgacaacagacttgaccattaatgaggacagtgttggtaggagtcagaaaagagcttcatattccccttttatattactgaagcaataagcaatctgagctgaagcagcaaaaagagtcacatttccatcaggtcatcatattccctgagtctctgcagcaaaagccatgtcagaggggagattataactaggtaactataacaagcacttgagcacttaccatgttccaagcactatcaccaaggtactgttggggtttatggcagtctaacggtaagaaaaatgtggtaaaatgaggtaatcatgctgctatagctttttgctttttttcatatagtatcaagttggtcagaattagctttctctgactggtctgcttccgtgtttctctgtgatggtgttaagattatgaaagaaaaagaagattacctaagactgctacaagtgttaactatatgcccttaagaatgagcttgactttggaagtaaagcttttcagatcttagtctacccggggcctttgttgatgggtctgtggttctgtagacccctggctttcactgtgttctcagaggtacaccagattgagagcagagttcttctttggaagtcccagagcaaaataactgccatcaagtgagtttgcattcgtatttgtttccccttccatagagggttagttttagttacctctagcttggagttcctgagaaggctggttataggactgagcgtgggaaaggaaccctcttcaggattacctcagtcccatcagtctaccccattgtgacattgagcccaacacacacgcttgacaccagactagacttgtcacagggccaaacccaacagccacatgccatagcttcactgcattttcagctacacctttggaggccaccttctcctatcaactgtggaaagccagaagggctcccttctccattctccttccctttttcaagtctaatagtgaaatctcctgcttaccccagcagtaaatagttgccttcctaccccttacctgggggccgataatttgagatactttgttttttcaatgcgtcagttgaaggatttagtttcttaaaagcaagaaatgttggagtgttgaatttttaaatagaatctcttttcatgtttgaatgattgttattagttctagaagcattctctttgtcatgacccgattatgtatactcttgggtttaggaaggacaaaagtgatgaaatttgcatgagatagaataaatatcttaggaggagtgaaagaacctgaggaagagacacgaccctaagggaatgaatgcataagcagtcttctcagtagcccagagtttccaggaaacaggaatatttatatcccttgcccactcttaaaatacatagatacataaaaaggcagtctctgtagacaacacatgcacacacccacacaaaacataattcctggggcttcctttttctgaatgttaatccattttatcgagcagtgattcccaaactttgagattttcagattttatgctctcgtctgttagattttatgacattctatcatcctaaaaaatgtactatatgtgttatatgtatatataagttaaagcaacttgaaattgacttggtttggcattgtctcaagaaccctagatatcattattgataccatggggaatcatagaaataaagttgaatatcattgatctgagagtaggatccagaaataagtagtttcagttcctgatcagttaagcctcaagtgtttgagtaaccaacacagcaagacttgggaaatgcagtgagcacccgaggaaaggaaagtggtagtctttgcctgcatttcagcatgcattttcctttcctactcagttgctatcttccacttaaataccctcatttgaccctaggaagttttttgtttttttttttagtttgagacttaaaaccagatttatttgttgttgtagagagatttccacagaagttgtgttttagggacctccatcatctttgtgggggtacagatatttatgtgtaaatatcattttatgtgatttccaaattttcgagggaaacatttcaattcccagttcaacaaaaggttaaatactaattgactcaatgaccaccttcaggaaagttaaatagtaaattaggttaaattttgactggtgcttagacatttcctagttatattaacttaagcagacagcagcacattaacctgagttacacctgtgaggaaatgaccttctaaatttgattttgtttttcatctccagggccttaataagagtgtgttaacacacgactattttacaatgatagctctaaataatttattttttatttcaagaaagagaaatacaccttagaaaaacaaaacccaagattttattttatttttaaagccatatttttgtgctagtagcatttagattattccgtatgtgagatccgtatcagcatttcattacctgggtttgttctaaagaagatttatttttgttctgtgaataatttttgacagttcttgtacatgtacagatatagatacgtttgaggtcttttattgatattcctacaaagaatacaaataaactttaactttaaacatttcagactaaagttgctactatatttgacatattgctgtcttctagcatgcacctgggtgactaggacacttgaagagaaacaagaaaggaaatgtatgccggaatattcttctaaaaatatattttaacattaagaacagtctgtcctagaatttcccaacttccatgtaataagatttcaatttaggaaaaataactagcattagcatgtattgtgataaaactgttactttcgaattctgcagaatttgaaatctctttaataacttgtgacaggtaaagaaagtttcatctggtttattaggaaatgtagccccacttagcttcctagaccactaccatcctcttgtaattttccagttagattaatggggtttgttttcaggatttttgatgtttggttcaggttttttattttaatttcttaatagaagttcatttgtcattcccaacatgattgttcccaaatacacccatcttctcctgcatccctgtttcattctgtaaaatccagggatgcaggtttcatgtgtagtcttgttttgtgttagttgtaggtctgtgctttttggcacatgtcgagttcttcctaatcttgttctactagggattaaaaaattaaaatttactcaaaatccagagaagattgcatgaaac

SEQ ID NO: 5500 - DNA, 9156 bp, Homo sapiens
cgaaatgagagcaaaaagggagagagcaggaaagcgagcacaggcgagtacagtatacaaagtgttttgagtttctgactggcgtgccggaaagatcatgttagcacacccagaaacttcacacgatgcagaccccagaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggttacctacttaagtggaagtaaatgcttcagctgtaattctgcttctgagagagacaagtggatggaaaaccttcgcaggacagttcaacctaataaggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgtgtctccacataccatcttcatcttcacacattcactgtgctttcctccccatagtgggagctgtcatcaccaacagggtttactctcccctggagaggttatttaaatagctgtccataagccatccagatcaacaccctttcttccatacagaaaagggctaaccataccacagctggaatctctgaatatttcctattaaaaattttttctatgtgttgttataatttttgtttgggataaagactctatccattgtactagcaaatctatggggggtaattttatctccatctttaacttttaaagtacttcttccccttatcccctcaataaagaaaggaaatccaaatttgaagcatcactctcttaaaagaaaaagaaaataatggaaagtgtcaggatggcacattccagttattattccaatgctcgtagatctgacaataatgacccaatttcaacacttgtcatccatagccttattattatagaacagaaaaagtcatggaaacgaattcatttccttttttccagaggtgtgcaatgtcatcttgaatgcaaccttgattaccagaagtatggaaggttacatgttaaacagacattatatatacaaatatatatataatatatattcacacatatgtacatataactgcacaaataggaaaagttcatgccttctatgctgttcagatataatgttaaaagggtctcaaacctctttaagcaagatctaagtagttgttttatattgagaaagcaacaatgtttctcgaataagttgatgttgattttaaattataagctttaaagaattttttttctagaaaaaggggatggaaaaaaaaggacctgagggagccatatgcatcaagtgagtgtttctccataacagaatatttataagagaacatgtatagtgccctcttttgagtgatgccgacagacaccaagccctccttttcaccaagtcccaggcttgcattccagcctcttgagctctgccctctctcaggtggatctttgtgttggaccttacgtttcagcaacctcaccatggccacataacccacaaccttttaaaacagtttctttcatagcaatccctgtttctgccagacagatctaaaatgggagtttctcactgtgtttatctgatctgcacactttatatccagctgttttggcacttttacgttttcttcacctttggttttggtttgcaaattcttacaccttctctccaagcggagggcacactgtggtcaaaatcacttattttattaggaaaaagaggtaactgttccaaagtgtagtgtcctttgttgaaggaggagggatgtaagcatagatttgttcttgtttctggctattctcagctcaagccatgtttaattcattctttgtaaaagccttcaattgtgccacagaaaacctggtaagagaattgtcagtttcattggccataagtatgtaatgtgggtgatgtcttgccattgaggtttggaagctcttaagtgccgattatggattacagagggctgataaaattacttatattgggaattgagagaagccccaaaaaatcaaatgtgcttttgatggatagagtgtatcttattagcattatgggagctccttagagggctgtcttcactgaaagatttaatgcccaaaacatttggacagattatgcagccttctactaccaggttatcttgaatgaagaagaaatagtaaaaaataataataatagagcattaccaataagctaaaagttcagagttgctgatagatgttaaatgttaagttatcctgtgagcctactcctgtccaaccttttttctcagtatttctttagagaatgctgcaatctgtataagttactctgaaggattttttaagaagagaagccaccaacaggtgataatttttatggagatgtttcttaattggctttccctcagttcaagtaggtaaataactttgtttgctgggaggaggtacatggctgaagagaggcaaatagattaagatagcaatgtcttgcacttcctgtttccctcaaaacaacaccacattgtggggcgcaggatagatcagggttgagtggaatttggaattcaggtgaagtgcttgtaaagtgcatgtctagctgacaacagacttgaccattaatgaggacagtgttggtaggagtcagaaaagagcttcatattccccttttatattactgaagcaataagcaatctgagctgaagcagcaaaaagagtcacatttccatcaggtcatcatattccctgagtctctgcagcaaaagccatgtcagaggggagattataactaggtaactataacaagcacttgagcacttaccatgttccaagcactatcaccaaggtactgttggggtttatggcagtctaacggtaagaaaaatgtggtaaaatgaggtaatcatgctgctatagctttttgctttttttcatatagtatcaagttggtcagaattagctttctctgactggtctgcttccgtgtttctctgtgatggtgttaagattatgaaagaaaaagaagattacctaagactgctacaagtgttaactatatgcccttaagaatgagcttgactttggaagtaaagcttttcagatcttagtctacccggggcctttgttgatgggtctgtggttctgtagacccctggctttcactgtgttctcagaggtacaccagattgagagcagagttcttctttggaagtcccagagcaaaataactgccatcaagtgagtttgcattcgtatttgtttccccttccatagagggttagttttagttacctctagcttggagttcctgagaaggctggttataggactgagcgtgggaaaggaaccctcttcaggattacctcagtcccatcagtctaccccattgtgacattgagcccaacacacacgcttgacaccagactagacttgtcacagggccaaacccaacagccacatgccatagcttcactgcattttcagctacacctttggaggccaccttctcctatcaactgtggaaagccagaagggctcccttctccattctccttccctttttcaagtctaatagtgaaatctcctgcttaccccagcagtaaatagttgccttcctaccccttacctgggggccgataatttgagatactttgttttttcaatgcgtcagttgaaggatttagtttcttaaaagcaagaaatgttggagtgttgaatttttaaatagaatctcttttcatgtttgaatgattgttattagttctagaagcattctctttgtcatgacccgattatgtatactcttgggtttaggaaggacaaaagtgatgaaatttgcatgagatagaataaatatcttaggaggagtgaaagaacctgaggaagagacacgaccctaagggaatgaatgcataagcagtcttctcagtagcccagagtttccaggaaacaggaatatttatatcccttgcccactcttaaaatacatagatacataaaaaggcagtctctgtagacaacacatgcacacacccacacaaaacataattcctggggcttcctttttctgaatgttaatccattttatcgagcagtgattcccaaactttgagattttcagattttatgctctcgtctgttagattttatgacattctatcatcctaaaaaatgtactatatgtgttatatgtatatataagttaaagcaacttgaaattgacttggtttggcattgtctcaagaaccctagatatcattattgataccatggggaatcatagaaataaagttgaatatcattgatctgagagtaggatccagaaataagtagtttcagttcctgatcagttaagcctcaagtgtttgagtaaccaacacagcaagacttgggaaatgcagtgagcacccgaggaaaggaaagtggtagtctttgcctgcatttcagcatgcattttcctttcctactcagttgctatcttccacttaaataccctcatttgaccctaggaagttttttgtttttttttttagtttgagacttaaaaccagatttatttgttgttgtagagagatttccacagaagttgtgttttagggacctccatcatctttgtgggggtacagatatttatgtgtaaatatcattttatgtgatttccaaattttcgagggaaacatttcaattcccagttcaacaaaaggttaaatactaattgactcaatgaccaccttcaggaaagttaaatagtaaattaggttaaattttgactggtgcttagacatttcctagttatattaacttaagcagacagcagcacattaacctgagttacacctgtgaggaaatgaccttctaaatttgattttgtttttcatctccagggccttaataagagtgtgttaacacacgactattttacaatgatagctctaaataatttattttttatttcaagaaagagaaatacaccttagaaaaacaaaacccaagattttattttatttttaaagccatatttttgtgctagtagcatttagattattccgtatgtgagatccgtatcagcatttcattacctgggtttgttctaaagaagatttatttttgttctgtgaataatttttgacagttcttgtacatgtacagatatagatacgtttgaggtcttttattgatattcctacaaagaatacaaataaactttaactttaaaca

SEQ ID NO: 5501 - DNA, 3290 bp, Homo sapiens
gttccgagggaggaagccaggcggggtgcagacggctgctgattctggggctggtcaggaaaccaaggagacccccccccccaaccatggacccaccgtcgccaagccggacctcccaaacccagcccacagccacctctccgctgacttcctaccgctggcacacagggggcggtggggagaaggcggctggagggttccgctggggccgctttgctggctggggcagggccctgagccaccaggagcccatggtcagcacccagccagcccctcgctcgatattccgtcgggtcctatctgcgcctcccaaggagtcacggaccagtcgccttcgactctccaaggccctctgggggaggcataagaacccaccgccggagccagacccggagccggagcaggaggccccagagctggagccggagccagagctggagccccctaccccacagatccctgaggcccccacacccaacgtgcctgtctgggacattgggggcttcaccctgcttgatgggaagctggtgctgcttggaggagaggaggagggtcctcgaaggccccgggtgggaagtgctagctccgagggcagcatccacgtggccatggggaacttcagggatccagatcggatgcctggaaaaacagaaccggagactgctggtcccaaccaggtccacaacgttcgggggttgctcaagaggctgaaagagaagaaaaaggccaggttggagccccgggatggaccccccagtgctctgggctctagggagtcgctggccacactctctgaactggacctgggtgccgagcgggatgtgcggatctggccactgcaccccagcctcctgggggagccccactgctttcaggtaacctggacgggtggaagccgctgcttctcttgtcgctcggccgctgagagagaccgctggatcgaggaccttcgtcgccaattccagcccacccaggacaacgtggagcgggaagagacatggctgagcgtgtgggtgcacgaagcgaaggggcttccccgagcagcggcgggggcacccggcgtgcgcgccgagctgtggctggatggcgcgctgctggcacgcacggcgcctcgggccggcccaggccagctcttctgggccgagcgcttccacttcgaggcgctgccaccggcacgtcgcctgtcgctgcggctgcgcggcttgggcccgggaagcgcggtgctgggccgcgtggccctggcgctggaggagctggacgccccacgcgcgcctgccgccggtctggagcgctggttcccgctgctcggggcgccggcgggcgcagcgctgcgggcgcggattcgggcgcgtcgcctgcgcgtgctgccgtccgagcgctacaaggagctggcggagttcctcaccttccactatgcgcgcctctgcggggccctggagcccgcgctgcctgcgcaggccaaggaggagctggcggcagccatggtgcgcgtgctgcgggccaccggccgggcgcaggcgctggtgactgacctgggcactgcggagctggcgcgctgtggaggccgtgaggcgctgctgttccgggaaaacacattggccaccaaggctatcgatgagtacatgaagctcgtggcacaggattacctccaggagaccctgggacaggttgtgcggcgtctctgtgcttctactgaggactgtgaagtggaccccagcaaatgtccagcctcggagctgccagagcaccaggccagacttcggaacagctgcgaggaggtcttcgaaaccattatccattcctacgactggttccctgcggagctgggcatcgtgttctcaagctggcgagaagcatgtaaagaacgtggctctgaggtgctgggcccccgactggtgtgcgcctccctcttcctgcggctcctgtgccctgccatcctggcacccagcctctttggtttggcaccagaccatccagcacccggcccagcccgcaccctcacactgattgccaaggtcatccagaacctcgccaaccgtgccccgttcggtgagaaggaggcctacatgggcttcatgaatagcttcctggaggaacatggaccagccatgcaatgcttcctggaccaggtagccatggtggatgtggatgctgcccccagtggttaccagggcagtggtgatctggccctccagttagctgtcctgcatgcccagctctgtacaatttttgctgagcttgaccagacaacccgagacaccctggaaccactgcccaccatcctgcgagccattgaggagggccagcctgtgcttgtgtcagtgccaatgcgtctcccactgcccccggcccaggtccactccagcctctccgcaggggagaagcccggcttcctggccccccgggacctccccaagcacacccctctcatctccaagagccagtctctgcgcagcgttcgccgctcagagagttgggcccggccacggccggacgaagagcggcccctgcggcggccccggccggtgcagcgcacgcagagtgtcccggtccggcgtcctgcccgccgccgccaatctgcggggccctggccgcgacccaaaggctccctgagcatgggaccagcgccccgcgcccggccttggacccgggactccgcctcgctgcctcggaagccgtcggtaccctggcagcgccaaatggaccagccgcaagaccgaaaccaggcactgggcacgcaccgacctgtgaacaagttggcagagctgcagtgcgaggtggccgctctgcgtgaggagcagaaagtgctgtcccgcctcgtggagtcgctgagcacccaaatccgggccttgacggagcagcaggagcagctgcggggccagctgcaggatctggactccaggctccgtgctgggagctcagagtttgattcagagcacaacctaacaagcaatgaagggcacagtctgaaaaacctggagcaccgcctaaatgagatggagagaactcaggctcagctgagggatgctgtccagagcctgcagctttctccaaggacgcgggggtcttggagtcaaccccagcccctcaaagcaccctgcctcaatggagacaccacctgagctgcccatcctgcctcatcacacgtggtctgggagcagagagatagccatcttagggggggtgtctgactttgccttagccctacttggcctacagtggggagtggagctgctggtcccaaccactctggcagtatgaagttgcccagtaaaatcttgatttcagtg

SEQ ID NO: 5502 - DNA, 855 bp, Homo sapiens
ccagagtaagagggacaggccagaatatgtatggaaaggtggcttttcctcggggcaaccgaggaaggccccaagaggacaatggattctggaactcgcccagttggtagctgctgtagcagccccgctgggctctcacgggagtacaaactagtgatgctgggtgctggtggtgtagggaagagtgccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatg

SEQ ID NO: 5503 - DNA, 3445 bp, Homo sapiens
gcgactcgggcgccggtggcgccatcttactcggttgcgggaggggtcacaggtcagtgccggagcctccgcgagtgaaggaagacgaagtgcgtgacccgaccggctgtggtgttccagtccccactgaccagtaggagcagcagggcgtcggcttgtgaggtggcttttcctcggggcaaccgaggaaggccccaagaggacaatggattctggaactcgcccagttggtagctgctgtagcagccccgctgggctctcacgggagtacaaactagtgatgctgggtgctggtggtgtagggaagagtgccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgcttttaaattgtcacattagaatttgttctaccaatgttttgggttctgttgcgctattaattaatgtaaatttgtttatacccaggagaatatgtataccatgtgtgtttgactaagttcacaagggaagtttttggctctgcactccacattatcctttaatttcaatttcctgggactatcccagagaaagacctcagtctcttctattcacactatgcttcctagagacagaacaaaaatcatgtagggaaattggggctaatgagatcagtgccaaatttcagcagatacctgtgaggctgacacctgttgcagactatggagtggtgagatttgggaaagttgggctatatgtttgcagggacttaaaaaggtaggttcagaacagtattctcagtacaagcttcgcttttctaagaagtacacatttggcccaaattcaccgggataagtgagaacagccagaagcataaaatgtgatgaaggtttctcctgggaaccttattttactcttcatttcagggttttctttttttttttaccttcaaaggtagacattttgggaatcataactgtattactaaacgtgtttaatcaaaattcatagttggatcagccattgccttgtacaggtttattttttccccacagacgcacacaccaacacatttatattcattgcttcctcccactttgtgctctgtaaaagagctacagctggcaagatgttttttcggcccttcatcactgattgcattttccatacagaagagacatcaggggtgtgggtaaaattgtgtgtgtgcctccttgacgtggacaatcactagactcagtgctctgagaaaatctgctatttctgttgaatgggtcagtcttaaagctttaaaattcacataggtggagtttcccatctgaagatttctttacaaggactttgctaagttcatctcagggttatctgagccttgaccaagtttatcctaagggaataccactttgctccctgtgcatagtttaggaactgtagtcctaggaggaaacagctttaaatattggtagtgagttgtctaagatcaggactgttttgatatctgaccttgttatatgcggagagtaaatgcaaaaatgctaagagtaatgcatcatgtattgaatattaagtgtcactgaagcaatgtttgtgttgactagaaacgtaagatgacttgtgtagcacctctttataagcacacagctcatcttaatattttccatttttattagaggaagtaggacagagttgtgtttttctttataaacaaatgataaactagcttttttaaaaagtgactgttagaacttttttagctctgagtagtggtccctttttaaactcctggaaacatttttgttaccaaataaatcatgttttatggtactcagccatccaaaagtgaaagacctagcatttgattctgtgcaggacacaaatctcacaggaactatagcactttggaaaagcatcaaagtagaaaagaaatacagtgcaattctattatgagaatgttttacatttaaactggtttagcaccttttaagtttaaagcccatagcttcttattactagtgacctagggaattgttattaacattaagagatatatatatatatatatatatatatttttttttttttttttttttttttttaaatagagatgaggtttcactatgttgcccaggctgatctcgaactcctaggctcaagcaatcctcccaatatgctgggattacaggcatgagccaccacctggcccaagcaagaaattgacactatatagttatttaaggtagtcaggcagtagaaacattgccagaaggatagaaaggaatttggattatatataaggaaaataacaaatcggtgtttttaagactatcactgtcatatattagatccttgtattagtccatccattaatattagttctattcgtggtgctaggtagcttgacaggtatgatatgcataagtcatagctctattcttagtgtcataaagtgtagctaatttataagctctaagtaatcagctttatctaatttgagggcattaaaattactgcctagaactttgagaagagaaaaattcagggataagttgaaaggcactggaactgttcatgtccataccagaccggtaaattataagatccagatgttagtgtctagaattagctgtttagaattcagaggggacatatgttttaactttgtcatatattagcaagaattggtctactgtgatgtttggggaggaggagggggggataatttttttaatgcacttgtatgtgaagacagtttgtatgacataatacaaaacttttaaacaa

SEQ ID NO: 5504 - DNA, 919 bp, Homo sapiens
gactcgggcgccggtggcgccatcttactcggttgcgggaggggtcacaggtcagtgccggagcctccgcgagtgaaggaagacgaagtgcgtgacccgaccggctgtggtgttccagtccccactgaccagtaggagcagcagggcgtcggcttgtgagccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgctttta

SEQ ID NO: 5505 - DNA, 635 bp, Homo sapiens
ggttgctatgagacccgctcgagcggaggaccagcagccagcccgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccaggcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccagcctacactgaaagagtttggaagggaagaattctga

SEQ ID NO: 5506 - DNA, 1092 bp, Homo sapiens
gttgctatgagacccgctcgagcggaggaccagcagccagcccgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccaggcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccaggtttctacagaagaaggcttgagtcttgcccaagaatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctcaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 5507 - DNA, 496 bp, Homo sapiens
ggtgaggtaggcgccgggcgacgcggggccggaacgcgaagagggtggtggagtcgggctacccactgattttccttcccttacttcccctgagcccttgggcccacttcccagcctaccgcttccgtccccgcccgactcttgggccagcgcctgggcccacactttcctatcccccgcagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagta

SEQ ID NO: 5508 - DNA, 422 bp, Homo sapiens
gctgcccggcgctccggaagcgattcatcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtca

SEQ ID NO: 5509 - DNA, 498 bp, Homo sapiens
gcggctcggagcagcatggtcccgctggcagagcccaccttccgaagccgctgcagtcctgggccccaggctcccggaagtgctgcccggcgctccggaagcgattcatcgggccgcgagcgccctccccgtcgttttccgtgagagacgtagagctgagcgacccagcccgcgagcgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtca

SEQ ID NO: 5510 - DNA, 288 bp, Homo sapiens
ggtgaggtaggcgccgggcgacgcggggccggaacgcgaagaggatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccat

SEQ ID NO: 5511 - DNA, 2217 bp, Homo sapiens
gctgggtcctgcttcctcctggtcttgtcgatgaggatttttagaccgtggagactgcgctgccctgccctgcacctaccctcactctccgtgttctcactaaggtggaaattgccttccctcactactgacgagaccatgtgtaaaagcgtgaccacagatgagtggaagaaagtcttctatgagaagatggaggaggcaaagccggctgacagctgggacctcatcatagaccccaacctcaagcacaatgtgctgagccctggttggaagcagtacctggaattgcatgcttcaggcaggttccactgctcctggtgctggcacacctggcagtcgccctacgtggtcatcctcttccacatgttcctggaccgcgcccagcgggcgggctcggtgcgcatgcgcgtcttcaagcagctgtgctatgagtgcggcacggcgcggctggacgagtccagcatgctggaggagaacatcgagggcctggtggacaacctcatcaccagcctgcgcgagcagtgctacggcgagcgtggcggccagtaccgcatccacgtggccagccgccaggacaaccggcggcaccgcggagagttctgcgaggcctgccaggagggcatcgtgcactggaagcccagcgagaagctgctggaggaggaggcgaccacctacaccttctcccgggcgcccagccccaccaagtcgcaggaccagacgggctcaggctggaacttctgctctatcccctggtgcttgttttgggccacggtcctgctgctgatcatctacctgcagttctctttccgtagctccgtataagattccgtggttgggcccagagcctgtcgagggtgccagttagctgatgcgagggtagaggagagacgtgggttgagaatagtgtaaacttctagcgctggtgatgtcactgactcagtggggatcttggacaaattatacagtttttccatctataaaactcagggtttgggcaagatcattggtttatcatagtgaaacccaggaccccaaagttctgcgtaggtgcctcagggacttttggatttggaaagtaggctaagctagtgggtgtctccaactcctgatctaaacacccatcctccaactcctacctcctcctcttgcttcgatcagaacagctttactttagatagggttccatttaagatttttgtaccaaaaaaaaaaaaaaaaaaagtttaactacttttaaaaagtttgaaaattagaggactgggtgatctcaaaagggctttccacagtaatgagctcgaccttgctcttattagtccctcacccctgcccctcatgatctcccactttctctagctgcagccttaaattagcttctttgcccaccctgtgagcctcatccgtgattctgccttcacacacgcagcagaggtttcccttgaagtgcaagaggtgggagatcaggctgttcctttgctgccaggtacacagggtctcttttttttgtttctcagattccagcttctttccactcagggcagattctggggtctgcctgcctgaaagatggtggttggggtggggtctcatagagttaggcttctcacccactgcgtattaactggcagagaatttaggggaggttcagaagacagagttttagaagcaaagcacaaaatctctgggaggcattataatggagggtcttcagagttcggggaccaagtctagcagattctcagcagtgctgatggccagaattcaggagcaggggcctggcctcctgggttctttgctgaaattatagttgaatggctttctcacattggccaagcatgaggcctcttgccaaagatcagctgtccccctaaagccacagggatggggtatcttcagcaagagagagggcgttaaagatgtaaaatgctttgtccatggggaagtgcacagatatgtgggagaaccttacaaggctctaaaatgagatgtgatatggcttgaaatgggaggagacactttctgacagtggggggtctggaatggaattggtggggacaggcagcaagctgcacttttgaggggcctcatttaccccacctctgttaaaaacttgactactctcctctttaatagaaagtcaccatcatctgtagtgatggaggaagggggtcacttatataaagatgggacactttaataaagacaggatatcttccataa

SEQ ID NO: 5512 - DNA, 1346 bp, Homo sapiens
ctagggtgtcgtacttaccatagcacatgatgtggagaatgctagaagagcagttgggtgaagcagggccaccaaatagtccttgcctcctggagacctctggaaatccagatgagtgtggtctgaggttgggcctcccactgtgcttgctcctctcaggcctacccagcgctgcctctgaagcctaactcagggccctgaaactcccccttggggcttcccttctccccagccctcactcttggtgccctgcctggctaccatggtaacaggttccagggtaacagaggagggagctgggtcctgtttactcccagtcctgccgatgaggattctgaccgtagacactgaattgtcccgtacctatccgtgctctttctgtgttctcaccagggctgagctcgaactgccacctctgccagcaggaccatgtgtaccagcttgaccacttgtgagtggaagaaagtcttctatgagaagatggaggtggcaaagccagcggacagctgggagctcatcatagaccccaacctcaagcccagtgagctggcccctggctggaagcagtacctggagcagcacgcctcaggcaggttccactgctcctggtgctggcacacctggcagtctgcccatgtggtcatcctcttccacatgttcctggaccgcgcccagcgggcgggctcggtgcgcatgcgcgtcttcaagcagctgtgctatgagtgcggcacggcgcggctggacgagtccagcatgctggaggagaacatcgagggcctggtggacaacctcatcaccagcctgcgcgagcagtgctacgaggaggatggtggccagtaccgcatccacgtggccagccgcccggacagcgggccgcatcgtgcagagttctgtgaggcctgccaggagggcatcgttcactggaagcccagcgagaagctgctggaggaggaggtgaccacctacacctctgaagcctccaagccgagggcccaggcgggatccggctacaacttcttgtctcttcgctggtgcctcttctgggcctctctctgcctgctcgttgtttacctgcagttctccttcctcagtcctgccttcttttagtggagctggttaagggtgggagagggcacatgggcttgagagtggggaggacacagtctggacttgatcctgctacagattcaacatatgactggacaatccggtcacctctctgggcctcagttaatgcatctgcggaatgagaggattgcattagaagataggcaatgattctttcactggatgtgacaataattgggggaaggggaaaagggtgtaataaaggttttagagcttgc

SEQ ID NO: 5513 - DNA, 4145 bp, Homo sapiens
cagccgggcgcgctcgacgcggacggcgggccagctgccggagcgcggcgactccaggggacccacagctggggcgccagagcgcggccatccgggcggggccgacggagcgcggcaggacttggctggacggcgcggccacggagaagggcgcggtgagcggactggcaccgcgcggggaacattccggaggccgccgggctcagtcccggtgacccccctgggtacagctctgccggggggggaaaaagtggtaccattttgggcgttcttgagcttcagaatgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcggcctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccac

SEQ ID NO: 5514 - DNA, 3864 bp, Homo sapiens
atgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcggcctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccacaa

SEQ ID NO: 5515 - DNA, 2670 bp, Homo sapiens
atgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacaggccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcggcctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccacaa

SEQ ID NO: 5516 - DNA, 3133 bp, Homo sapiens
cattttgggcgttcttgagcttcagaatgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatg

SEQ ID NO: 5517 - DNA, 738 bp, Homo sapiens
ttaaaatgacagtgtctgttggccacatatgcagtctgaactttgctttgcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaa

SEQ ID NO: 5518 - DNA, 804 bp, Homo sapiens
cctcgccttcctccggctcagccgccgcgccgccgggctgctccttcttcctcctcgggcgcccgcggcgatgttcaaccgcgccgtgagccggctgagcaggaagcggccgccgtcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaa

SEQ ID NO: 5519 - DNA, 852 bp, Homo sapiens
ggcgtctctgggaaggcagtggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggcc

SEQ ID NO: 5520 - DNA, 2376 bp, Homo sapiens
gccatggccgccggccccgcgccgccccccggccgcccccgggcgcagatgccgcatctgaggaaggtgcgaggcggatggagcgggtggtcgtgagcatgcaggaccccgaccagggcgtgaagatgcggagccagcgcctgctggtcaccgtcattccccacgcggtgacaggcagcgacgtcgtgcagtggttggcccagaagttctgcgtctcggaggaggaggccctgcacctgggcgccgtcctggtgcagcatggctacatctacccgctgcgcgacccccgtagcctcatgctccggccagacgagacgccctacaggttccagaccccgtacttctggacaagtaccctgaggccggctgcagagctggactatgccatctacctggccaagaagaacatccgaaaacgggggaccctggtggattatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgcccggggcccccgatgtgctggagcagggtccagggcggggatcctgcgctgccagccgtgtgctcatgaccaagagtgcagatttccataagcgggagatcgagtacttcaggaaagcgctgggcaggacccgagtgaagtcctccgtctgccttgaggcgtacctgagtttctgcggccagcgtggaccccacgatcccctcgtgtcggggtgcctgcccagcaatccctggatctcagacaatgacgcctactgggtcatgaatgcccccacggtggctgcccccacgaagctccgtgtggagagatggggcttcagcttccgggagctcctggaggaccccgtggggcgggcccacttcatggactttctgggaaaggagttcagtggagaaaacctcagcttctgggaggcatgtgaggagcttcgatatggagcgcaggcccaggtccccaccctggtggatgccgtgtacgagcagttcctggcccccggagctgcccactgggtcaacatcgacagccggaccatggagcagaccctggaggggctgcgccagccccaccgctatgtcctggatgacgcccagctgcacatatacatgctcatgaagaaggactcctacccaaggttcctgaagtctgacatgtacaaggccctcctggcagaggctgggatcccgctggagatgaagagacgcgtgttcccgtttacgtggaggccacggcactcgagccccagccctgcactccttcccacccctgtggagcccacagcggcttgtggccctgggggtggagatggggtggcctagtggacctggcccatctgccactctagtccctgcagctcaacgtcctgcgtgaatgcagcagccacccccgtcttggcccaggtcctgggggctgctgaacccagcaccagtgtccccttgtgcccagggggcccagtcttctgtggggtgcacagcctccctccctccagcaagccctccctgcccagaaggaatgggtccaggtgtggattcccagggagggggttcattggctcagcttgggtcagggcagagcctgttacctgaagagaggtgagaccaaggccacagggagctccaccttctctggtcttcagtccagcactgggtgcccatccccatctctaaaaccagtaaatcagccagcgaatacccggaagcaagatgcacaggcgggcggcttcccacacacccgtcacaagacgcggacatgcaggtctcggcgcgagctctgccccgtccaagagcctctccgctgtcgcccagtgtgagcctggaagaggacccaagagagtgccgtgctgaggctgcctcgaggtcactgccttccggagctgcgcctattcctccctcgccaaacgcgttccagaatttgtccacaggtgcgccggcacctgctttcccacctcgaggccgcggcctcccccccgatttatagacaactctgacattgtcaccccactgacgaggcccgattccatagggtggatccttgccaggcgtccctgatcctccctgcccaagtcttccttcgtgagctggccttgctccccatcccccaagtgcctcaccagtcccccagactgggtgaaggtacagctggctcctttcgggggtgcagcttcaactctctcggcggtagggcggtgccatccccacccatagggctggctcacatccagtcactcccaacagcgtccagcacacaaataaaagacccttgggccctggctctgag

SEQ ID NO: 5521 - DNA, 918 bp, Homo sapiens
atccccgccggcctcgccccgcagccatggccgccggccccgcgccgccccccggccgcccccgggcgcagatgccgcatctgaggaagatggagcgggtggtcgtgagcatgcaggaccccgaccagggcgtgaagatgcggagccagcgcctgctggtcaccgtcattccccacgcggtgacaggcagcgacgtcgtgcagtggttggcccagaagttctgcgtctcggaggaggaggccctgcacctgggcgccgtcctggtgcagcatggctacatctacccgctgcgcgacccccgtagcctcatgctccggccagacgagacgccctacaggttccagaccccgtacttctggacaagtaccctgaggccggctgcagagctggactatgccatctacctggccaagaagaacatccgaaaacgggggaccctggtggattatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgcccggggcccccgatgtgctggagcagggtccagggcggggatcctgcgctgccagccgtgtgctcatggtggaggcctccagaaccagagggaccagaccagagggagcatctgagccccgcagcagcaaaaccctttgttcaaaccagtcccatccagacccaacatctggaaagatgcacctagaacctcactgataaaacttcttaagttcacgaccctaacatttccccatacaaagctggtcagagagagcggggacacaggccaggactcgcagcgcgtccgcctcctccgctctgg

SEQ ID NO: 5522 - DNA, 2390 bp, Homo sapiens
cggcctcgccccgcagccatggccgccggccccgcgccgccccccggccgcccccgggcgcagatgccgcatctgaggaagatggagcgggtggtcgtgagcatgcaggaccccgaccagggcgtgaagatgcggagccagcgcctgctggtcaccgtcattccccacgcggtgacaggcagcgacgtcgtgcagtggttggcccagaagttctgcgtctcggaggaggaggccctgcacctgggcgccgtcctggtgcagcatggctacatctacccgctgcgcgacccccgtagcctcatgctccggccagacgagacgccctacaggttccagaccccgtacttctggacaagtaccctgaggccggctgcagagctggactatgccatctacctggccaagaagaacatccgaaaacgggggaccctggtggattatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgcccggggcccccgatgtgctggagcagggtccagggcggggatcctgcgctgccagccgtgtgctcatgaccaagagtgcagatttccataagcgggagatcgagtacttcaggaaagcgctgggcaggacccgagtgaagtcctccgtctgccttgaggcgtacctgagtttctgcggccagcgtggaccccacgatcccctcgtgtcggggtgcctgcccagcaatccctggatctcagacaatgacgcctactgggtcatgaatgcccccacggtggctgcccccacgaagctccgtgtggagagatggggcttcagcttccgggagctcctggaggaccccgtggggcgggcccacttcatggactttctgggaaaggagttcagtggagaaaacctcagcttctgggaggcatgtgaggagcttcgatatggagcgcaggcccaggtccccaccctggtggatgccgtgtacgagcagttcctggcccccggagctgcccactgggtcaacatcgacagccggaccatggagcagaccctggaggggctgcgccagccccaccgctatgtcctggatgacgcccagctgcacatatacatgctcatgaagaaggactcctacccaaggttcctgaagtctgacatgtacaaggccctcctggcagaggctgggatcccgctggagatgaagagacgcgtgttcccgtttacgtggaggccacggcactcgagccccagccctgcactccttcccacccctgtggagcccacagcggcttgtggccctgggggtggagatggggtggcctagtggacctggcccatctgccactctagtccctgcagctcaacgtcctgcgtgaatgcagcagccacccccgtcttggcccaggtcctgggggctgctgaacccagcaccagtgtccccttgtgcccagggggcccagtcttctgtggggtgcacagcctccctccctccagcaagccctccctgcccagaaggaatgggtccaggtgtggattcccagggagggggttcattggctcagcttgggtcagggcagagcctgttacctgaagagaggtgagaccaaggccacagggagctccaccttctctggtcttcagtccagcactgggtgcccatccccatctctaaaaccagtaaatcagccagcgaatacccggaagcaagatgcacaggcgggcggcttcccacacacccgtcacaagacgcggacatgcaggtctcggcgcgagctctgccccgtccaagagcctctccgctgtcgcccagtgtgagcctggaagaggacccaagagagtgccgtgctgaggctgcctcgaggtcactgccttccggagctgcgcctattcctccctcgccaaacgcgttccagaatttgtccacaggtgcgccggcacctgctttcccacctcgaggccgcggcctcccccccgatttatagacaactctgacattgtcaccccactgacgaggcccgattccatagggtggatccttgccaggcgtccctgatcctccctgcccaagtcttccttcgtgagctggccttgctccccatcccccaagtgcctcaccagtcccccagactgggtgaaggtacagctggctcctttcgggggtgcagcttcaactctctcggcggtagggcggtgccatccccacccatagggctggctcacatccagtcactcccaacagcgtccagcacacaaataaaagacccttgggccctggctctgagcccatcctgc

SEQ ID NO: 5523 - DNA, 808 bp, Homo sapiens
agccatggccgccggccccgcgccgccccccggccgcccccgggcgcagatgccgcatctgaggaaggtgcgaggcgggcagcgacgtcgtgcagtggttggcccagaagttctgcgtctcggaggaggaggccctgcacctgggcgccgtcctggtgcagcatggctacatctacccgctgcgcgacccccgtagcctcatgctccggccagacgagacgccctacaggttccaggtcaggctcgggggtgcaggtgggagccggtgggacccccacccccacccacccagcttaccaactcggggagacaggaggggcgccgagcttgctgggattggagtgggactccgccatgtcgccgtgggctggtggtccatcgccccctccccaaaagtcctggaccgcaagtacggatgtggtgagaaggacccggctgagggatggagcctcagttttcctggggaccacagcagggccccacaaggggtcgtatgtgcagaggattctgccatcttcctgggggtccctaggcccaggtcctgagggaggggctgtgaaggcctgaggacagcattcctgccctccctaaccacatcagggtcccgggccgacctgccgtcggttgtacccctccccaggcacagactgtgactacatccaagacttgtgcaggcccccagccccaccccgccttgaatgggggcttagggtgaccagtgagggaggcagtgtctgaacagggccctaaggagcgagttgacctcagttctagttggagagactggccagtggtcagtggagtctct

SEQ ID NO: 5524 - DNA, 1505 bp, Homo sapiens
tcatactgaggccagagtgccatcgaaggtaattatagagacagtaaaatccttttactctgggaaaaataaaatgctgggtgtctcacaaaatttcagaacctgatttcaaacggatcataacaaagaggagatcaaatttagcatggtggactgctcgacaggatatatttgtcaatggaatgtttccacatattataccaccaacatgagaaaaaaatgatcattgtttatttgaagcttgatgatattctaacgctgccttttctcttctcattttagagaaaaatgagcaggcggaattgttggatttgtaagatgtgcagagatgaatctaagaggcccccttcaaaccttactttggaggaagtattacagtgggcccagtcttttgaaaatttaatggctacaaaatatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttctttaaaaattgttgttatatgaattgtgtttctagcatgaatgttctatagagtactctaaataacttgaatttatagacaaatgctactcacagtacaatcaattgtattataccatgagaaaatcaaaaaggtgttcttcagagacattttatctataaaattttcctactattatgttcattaacaaacttctttatcacatgtatcttctacatgtaaaacatttctgatgattttttaacaaaaaatatatgaatttcttcatttgctcttgcatctacattgctataaggatataaaatgtggtttctatattttgagatgttttttccttacaatgtgaactcatcgtgatcttggaaatcaataaagtcaaatatcaactaaa

SEQ ID NO: 5525 - DNA, 1458 bp, Homo sapiens
gaggccagagtgccatcgaaggtaattatagagacagtaaaatccttttactctgggaaaaataaaatgctgggtgtctcacaaaatttcagaacctgatttcaaacggatcataacaaagaggagatcaaatttagcatggtggactgctcgacaggatatatttgtcaatggaatgtttccacatattataccaccaacatgagaaaaaaatgatcattgtttatttgaagcttgaaaaatgagcaggcggaattgttggatttgtaagatgtgcagagatgaatctaagaggcccccttcaaaccttactttggaggaagtattacagtgggcccagtcttttgaaaatttaatggctacaaaatatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttctttaaaaattgttgttatatgaattgtgtttctagcatgaatgttctatagagtactctaaataacttgaatttatagacaaatgctactcacagtacaatcaattgtattataccatgagaaaatcaaaaaggtgttcttcagagacattttatctataaaattttcctactattatgttcattaacaaacttctttatcacatgtatcttctacatgtaaaacatttctgatgattttttaacaaaaaatatatgaatttcttcatttgctcttgcatctacattgctataaggatataaaatgtggtttctatattttgagatgttttttccttacaatgtgaactcatcgtgatcttggaaatcaataaagtcaaatatcaactaaa

SEQ ID NO: 5526 - DNA, 1636 bp, Homo sapiens
ctctcctcgcccgctgggtgctgaagttgggcggatggcagcaaaccggctccgctagaggaccgagccgcccagccccgctcccccggacccatcggcgcgctgcccacacctccaggcgaccggccaactgggtcctgaagtagctgaaatgcgaaaaaggcagcagtcccaaaatgaaggaacacctgccgtgtctcaagctcctggaaaccagaggcccaacaacacctgttgcttttgttggtgctgttgttgcagctgctcctgcctcactgtgaggaatgaagaaagaggggaaaatgcgggaagacccacacacactacaaaaatggagagtatccaggtcctagaggaatgccaaaaccccactgcagaggaagtcttgtcctggtctcaaaattttgacaagatgatgaaggccccagcaggaagaaaccttttcagagagttcctccgaacagaatacagtgaagagaacctacttttctggcttgcttgtgaagacttaaagaaggagcagaacaaaaaagtaattgaagaaaaggctaggatgatatatgaagattacatttctatactatcaccaaaagaggtcagtcttgattctcgagttagagaggtgatcaatagaaatctgttggatcccaatcctcacatgtatgaagatgcccaacttcagatatatactttaatgcacagagattcttttccaaggtttttgaactctcaaatttataagtcatttgttgaaagtactgctggctcttcttctgaatcttaatgttcatttaaaaacaatcattttggagggctgagatgggaaataaaagtagttaaataacatcagaaactgagttcctggagaactacagtttagcattcctcaggctactgtgaaaacacaaccgttatggtctttgtctccatttttatcaaggttttccatggttaagtttggagaaaataccacacaaaacaatgaattgccaaattgtttgttttattcaagactcattctacttgcaagcaaagtgtatttgtagtcctatgaacagtctcctcgtgtatctccagagactgcatgtgcaaagtaaaatgcttcatttgccacatagttgttgtaatatttaatccagtagcataacttatatctgtatttaaggacttttgtgcaatatggtcttaagaaataattgccaaaaaaatcggccatggtttgcattttttaacataatctaagacagaaaaaaagcaatttttactatgtaacaatggtattcaacattctatatactgtgtttagtacactaattttgaagccaatatttctgtacatgaaaaagagctatttatctctgtttgttggaaaatcctaatggggattcctctggttgttcactgccaaaactgtggcattttcattacaggagagtttactatgctaaaagcaaaaaacaaaaaaaaaaaaaaagggaagaaggaaaaaagcacaaaacaatttgaagatatcctatctcaatgacaaatcaaaagagtgatattgcttttaactgtaatagaagaaaatgaatttatgtatatatcagatgtccaatactgtaattaatttattaaagactggctctccagtttt

SEQ ID NO: 5527 - DNA, 1510 bp, Homo sapiens
ccaactgggtcctgaagtagctgaaatgcgaaaaaggcagcagtcccaaaatgaaggaacacctgccgtgtctcaagctcctggaaaccagaggcccaacaacacctgttgcttttgttggtgctgttgttgcagctgctcctgcctcactgtgaggaatgaagaaagaggggaaaatgcgggaagacccacacacactacaaaaatggagagtatccaggtcctagaggaatgccaaaaccccactgcagaggaagtcttgtcctggtctcaaaattttgacaagatgatgaaggccccagcaggaagaaaccttttcagagagttcctccgaacagaatacagtgaagagaacctacttttctggcttgcttgtgaagacttaaagaaggagcagaacaaaaaagtaattgaagaaaaggctaggatgatatatgaagattacatttctatactatcaccaaaagaggtcagtcttgattctcgagttagagaggtgatcaatagaaatctgttggatcccaatcctcacatgtatgaagatgcccaacttcagatatatactttaatgcacagagattcttttccaaggtttttgaactctcaaatttataagtcatttgttgaaagtactgctggctcttcttctgaatcttaatgttcatttaaaaacaatcattttggagggctgagatgggaaataaaagtagttaaataacatcagaaactgagttcctggagaactacagtttagcattcctcaggctactgtgaaaacacaaccgttatggtctttgtctccatttttatcaaggttttccatggttaagtttggagaaaataccacacaaaacaatgaattgccaaattgtttgttttattcaagactcattctacttgcaagcaaagtgtatttgtagtcctatgaacagtctcctcgtgtatctccagagactgcatgtgcaaagtaaaatgcttcatttgccacatagttgttgtaatatttaatccagtagcataacttatatctgtatttaaggacttttgtgcaatatggtcttaagaaataattgccaaaaaaatcggccatggtttgcattttttaacataatctaagacagaaaaaaagcaatttttactatgtaacaatggtattcaacattctatatactgtgtttagtacactaattttgaagccaatatttctgtacatgaaaaagagctatttatctctgtttgttggaaaatcctaatggggattcctctggttgttcactgccaaaactgtggcattttcattacaggagagtttactatgctaaaagcaaaaaacaaaaaaaaaaaaaaagggaagaaggaaaaaagcacaaaacaatttgaagatatcctatctcaatgacaaatcaaaagagtgatattgcttttaactgtaatagaagaaaatgaatttatgtatatatcagatgtccaatactgtaattaatttattaaagactggctctccagtttt

SEQ ID NO: 5528 - DNA, 2150 bp, Homo sapiens
tcctcagttctgcatttctgcagagacagaaagaaacgcagctcttgacttcttttttgtaaacattactgtaagagttgtgataactttttattctactatgtatatgtatggaatagtattaataaatgaactagggaaggatgtaataaattagacatctcttcattttagagagaagatggaaacaacattgcttttcttttctcaaataaatatgtgtgaatcaaaagaaaaaacttttttcaagttaatacatggttcaggaaaagaagaaacaagcaaagaagccaaaatcagagctaaggaaaaaagaaatagactaagtcttcttgtgcagaaacctgagtttcatgaagacacccgctccagtagatctgggcacttggccaaagaaacaagagtctcccctgaagaggcagtgaaatggggtgaatcatttgacaaactgctttcccatagagatggactagaggcttttaccagatttcttaaaactgaattcagtgaagaaaatattgaattttggatagcctgtgaagatttcaagaaaagcaagggacctcaacaaattcaccttaaagcaaaagcaatatatgagaaatttatacagactgatgccccaaaagaggttaaccttgattttcacacaaaagaagtcattacaaacagcatcactcaacctaccctccacagttttgatgctgcacaaagcagagtgtatcagctcatggaacaagacagttatacacgttttctgaaatctgacatctatttagacttgatggaaggaagacctcagagaccaacaaatcttaggagacgatcacgctcatttacctgcaatgaattccaagatgtacaatcagatgttgccatttggttataaagaaaattgattttgctcatttttatgacaaacttatacatctgcttctaacatatcgcatgtttatgttaagatttggtcccatcctttaaactgaaatatgtcatgtgaaattattttaaaaatgtaaaaacaaaactttctgctaacaaaatacatacagtatctgccagtatattctgtaaaaccttctatttgatgtcattccatttataatcagaaaaaaaacttatttcttaatcaaaaggcagtacaaaaaaagtaataatgttttataagattgtagagttaagtaaaagttaagcttttgcaaagttgtcaaaagttcaaacaaaagtctagttgggattttttaccaaagcagcataatatgtgttatataaacataataatactcagatatccaaatgttcagatagcatttttcataatgaatgttctcttttttttggtaatagtgtagaagtgatctggttcttacaatgggagatgaagaacatttattattgggttactactaaccctgtcccaagaatagtaatatcacctctagttataagccagcaacaggaacttttgtgaagacacattcatctctacagaacttcagattaaatataatctagattaatgactgagaataagatccacatttgaactcattcctaagtgaacatggacgtacccagttatacaaagtacttctgttggtcacagaaacatgaccagattttgcatatctccaggtagggaactaagtagactaccttatcaccggctaagaaaacttgctactaaactattaggccatcaatggcttgaataaaaaccagagaaggtttttcccaggacgtctcatgtttggccctttagaattggggtagaaatcagaaatgagatgaggggaagaagcaaggagtctaaggccctagcgatttgggcatctgccacattggttcatattcagaaagtgttatctcattgattatattcttgttaagcaaatctccttaagtaattattattcaaataagattatactcatacatctatatgtcactgttttaaagagatatttaatttttaatgtgtgttacatggtctgtaaatatttgtatttaaaaatgccatgcattaggctttggaaatttaatgttagttgaaatgtaaaatgtgaaaactttagatcatttgtagtaataaatatttttaacttcattcatacagttaagtttatctgacaataaaagctctgactgaa

SEQ ID NO: 5529 - DNA, 1489 bp, Homo sapiens
gcctgcgcactgcgcccccgcgccccctccccgactgtcgggccggaccttggagcgcgcgggccggcggcggcgcgagtggctcgggagcgcggctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctaggccgcccccagcagcacagaccccgccgcctcctacggccgactctgggttcccttcaggtgttgttgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctggggcctcctccccaggcagccaatgggccccagacaagcctttggtggggaacagaacctccgcatcgtgtagttttgtgacataaggagacctcctacttgagctgtctgtaccccagaatcaaacacagaacctcagaaccagatttaggacctcagaatcctgcactcaaggtggcaggacccaatttctgttttatatgttcatgaactttaaacctggaaacatgtccttactaggtgttttatcaaaaaaaagttttcatatttatctctatccctaaccccccaaaaataggatgtcttattattgaagatatttttaaagc

SEQ ID NO: 5530 - DNA, 1593 bp, Homo sapiens
agctgtaggggaggcgctgcgcccccggccccagccgatcgggggctcctggcgctagcctccctccagagcgccgcaggagtccctcctgccgtctgacttgagtccctgctgctgcagtgcacgccccttcggcagccagggtggggcccagacccaacctggcccctcctgcccccaccccgcctttgggtcgctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctaggccgcccccagcagcacagaccccgccgcctcctacggccgactctgggttcccttcaggtgttgttgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctggggcctcctccccaggcagccaatgggccccagacaagcctttggtggggaacagaacctccgcatcgtgtagttttgtgacataaggagacctcctacttgagctgtctgtaccccagaatcaaacacagaacctcagaaccagatttaggacctcagaatcctgcactcaaggtggcaggacccaatttctgttttatatgttcatgaactttaaacctggaaacatgtccttactaggtgttttatcaaaaaaaagttttcatatttatctctatccctaaccccccaaaaataggatgtcttattattgaagatatttttaaagcaaa

SEQ ID NO: 5531 - DNA, 1664 bp, Homo sapiens
gggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctccagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaa

SEQ ID NO: 5532 - DNA, 2104 bp, Homo sapiens
cattaaccaaacaaagagaagcagagtggatcctgtgctaatattgggaaaaccaggcaacaggactcatttggggcctttattgtgaaaacatgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccgcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 5533 - DNA, 4296 bp, Homo sapiens
ccggcctcggcctccctgggcggccgtattgtctaagctccatagcaaccccggcgcggcgccggccacgctagccagcgtagctccggagcccgcgcgccgtcgccgcgtcgctcaggccctgacccgcgctggacccgcgcgctagggccctgacggcccgcgcgggctccaggcgcgggcagcggggacggcatgcccgagaagaggctcaccgcggagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgtaattatgaaaaagttctatgtatcacttggtgaggcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataaaaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaataaagaaaatttggcttgtcttactctcgcagttttaaaattatagctattctgtacacatgacatacaagactataagaactgtttaacttatttagaataaaacaactactatctaggtttgaagaaccaaaa

SEQ ID NO: 5534 - DNA, 4145 bp, Homo sapiens
ccggcctcggcctccctgggcggccgtattgtctaagctccatagcaaccccggcgcggcgccggccacgctagccagcgtagctccggagcccgcgcgccgtcgccgcgtcgctcaggccctgacccgcgctggacccgcgcgctagggccctgacggcccgcgcgggctccaggcgcgggcagcggggacggcatgcccgagaagaggctcaccgcggagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataaaaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagatggatcttatgtgctggacagacattgagcagttccggagaaacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaataaagaaaatttggcttgtctta

SEQ ID NO: 5535 - DNA, 765 bp, Homo sapiens
gttcagggaccacgcttggagaaccactacactagggcaagcaggaagagagtcctccttctggaactgaagcaggcagtgtgaagacccatgtggaacaccttaacccgaagcctctctgaccatccagttggcaaagaccctcaggccatgaggactggccaaagacagaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgctgccaagatcatattctaatgtgaaatgtc

SEQ ID NO: 5536 - DNA, 843 bp, Homo sapiens
gggaggtgtgttgtgcatgcctgtgtgtgtatatgtgtgtgtgtgcccctatgtgttcatgcacacatgcccttcactcgccgaggatttgactgctaaaagaaagatctactttttccccagaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttag

SEQ ID NO: 5537 - DNA, 859 bp, Homo sapiens
ggaccacgcttggagaaccactacactagggcaagcaggaagagagtcctccttctggaactgaagcaggcagtgtgaagacccatgtggaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgct

SEQ ID NO: 5538 - DNA, 1432 bp, Homo sapiens
gcttcagtatttactggatgtgacaagcagagagaagagctttcagtggggccgcttgctgcctggctcaagtggtgggagaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgctgccaagatcatattctaatgtgaaatgtcataggtgttcaaaagcggtggcattgggggtgggaggctgggggtgaggagggaatgaagggccattccaaagtatgacccagctgccggagcttggactctattccatttacccatgtttgtgttttggttagtggtagcgccttgccgctgtcacccttttctgggtcagcaacttgcccttcatataatgccttgggtcacctctgctgagagggcagatttgctgtgctaggctaatctgtaaataatgcaaatgcaattcccaccacctccacaccctcctcggttaggattcctgactctccacttgttgtaaatccctgggaggaatagctgaaagacttgggctcaactctgtgatttgtagtggccagctctgctcactgggatctcacagcttaggagagaggtttctgtggaattccaggtttctagttctgtcattgacaggtgacctctcagagaaggagtgaaatccatggagttgtttgtttcttccatttccattggaccagtgtgaaaaactgtgattacttcccatcttggccta

SEQ ID NO: 5539 - DNA, 563 bp, Homo sapiens
ctttacgctccccactcccggtgcagcagccaaccttcagccagcagcggggctcattagaagagggtcccctggacacttgatttttagctcactggtgactggaaagagttaatacctattctttgctgccccccgcacagcctctgggtgcagagggaggcagctgtgggctgtggggacttctccctgagctgcagccagaggagcttcagaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattccttt

SEQ ID NO: 5540 - DNA, 3842 bp, Homo sapiens
aaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactattaaaaa

SEQ ID NO: 5541 - DNA, 770 bp, Homo sapiens
gagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtccagagcagtaaaggatggctctgaaaaatga

SEQ ID NO: 5542 - DNA, 3196 bp, Homo sapiens
agaacaatggtgacctgcactcagaacatgaaggcagccttgaaatccttactttatcattcccgcaatctggggtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactatt

SEQ ID NO: 5543 - DNA, 3702 bp, Homo sapiens
acacaaccactgtgagctgtatgcgattcagaaaccaagaccaaattttgctcactttcattaatcagttgctcagatagaaggaaatgacatctggttctgtcttcttctacatcttaatttttggaaaatatttacttcctcctgaagaatgaactttcaaacttttttattaacactccatctcccacctagaatcaaatagtattacaacagctggtactgcctcttccttcgacacagaagaaaacctaaaatccagtaagacagagtggcatgccaaatttgcccatcaatttattggcacattcaagaataaagcaaaactctactgaatatcgatatagtagtatctgcctctgaggattcttggtgcatatttttgcattctgccatgtttcgtccattttgcccctaccttgggcatttaaatataaagattcccatgagatcggatcaattcagctgtttatttctagaaatgtctataaagagaagaactaacaagagaaccatctttttatttttttaatttacttcctaaatataaatgaaggagaatctagaaccactgtcttcattggaaatcattgttccaaatgaaccgcaagtctgagtttataaagctgccatctccaatatgtctgttgagaaatatgtctatttacatacatcatgtttgtttctgaccttgtgggacaataacttggaatgccctgagcaacaaaaacataaaacactctgatgagacagcatctcatccttgcactgaaggatttcaaaagagggacagatcacccagaatggacatggtcatagaggaatttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagaga

SEQ ID NO: 5544 - DNA, 3676 bp, Homo sapiens
aatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgacactctaaagaacaatggtgacctgcactcagaacatgaaggcagccttgaaatccttactttatcattcccgcaatctggggtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactattaaaaa

SEQ ID NO: 5545 - DNA, 2803 bp, Homo sapiens
tgaacttactacatcagaactcctgctgaggtataagaggatacgtctaataactcaattgctgtaaacctatgattgtttttctggtttttaaacatctcttcagcctcagattgattacaatgttctttctacttcatttcatcgttctgatcaatgtcaaagattttgcactgactcaaggtagcatgatcactccttcatgccaaaaaggatattttccctgtgggaatcttaccaagtgcttaccccgagcttttcactgtgatggcaaggatgactgtgggaacggggcggacgaagagaactgtggtgacactagtggatgggcgaccatatttggcacagtgcatggaaatgctaacagcgtggccttaacacaggagtgctttctaaaacagtatccacaatgctgtgactgcaaagaaactgaattggaatgtgtaaatggtgacttaaagtctgtgccgatgatttctaacaatgtgacattactgtctcttaagaaaaacaaaatccacagtcttccagataaagttttcatcaaatacacaaaacttaaaaagatatttcttcagcataattgcattagacacatatccaggaaagcattttttggattatgtaatctgcaaatattatatctcaaccacaactgcatcacaaccctcagacctggaatattcaaagacttacatcagctaacttggctaattctagatgacaatccaataaccagaatttcacagcgcttgtttacgggattaaattccttgtttttcctgtctatggttaataactacttagaagctcttcccaagcagatgtgtgcccaaatgcctcaactcaactgggtggatttggaaggcaatagaataaagtatctcacaaattctacgtttctgtcgtgcgattcgctcacagtgctgtttctgcctagaaatcaaattggttttgttccagagaagacattttcttcattaaaaaatttaggagaactggatctgtctagcaatacgataacggaactatcacctcacctttttaaagacttgaagcttctacaaaagctgaacctgtcatccaatcctcttatgtatcttcacaagaaccagtttgaaagtcttaaacaacttcagtctctagacctggaaaggatagagattccaaatataaacacacgaatgtttcaacccatgaagaatctttctcacatttatttcaaaaactttcgatactgctcctatgctccccatgtccgaatatgtatgcccttgacggacggcatttcttcatttgaggacctcttggctaacaatatcctcagaatatttgtctgggttatagctttcattacctgctttggaaatctttttgtcattggcatgagatctttcattaaagctgaaaatacaactcacgctatgtccatcaaaatcctttgttgtgctgattgcctgatgggtgtttacttgttctttgttggcattttcgatataaaataccgagggcagtatcagaagtatgccttgctgtggatggagagcgtgcagtgccgcctcatggggttcctggccatgctgtccaccgaagtctctgttctgctactgacctacttgactttggagaagttcctggtcattgtcttccccttcagtaacattcgacctggaaaacggcagacctcagtcatcctcatttgcatctggatggcgggatttttaatagctgtaattccattttggaataaggattattttggaaacttttatgggaaaaatggagtatgtttcccactttattatgaccaaacagaagatattggaagcaaagggtattctcttggaattttcctaggtgtgaacttgctggcttttctcatcattgtgttttcctatattactatgttctgttccattcaaaaaaccgccttgcagaccacagaagtaaggaattgttttggaagagaggtggctgttgcaaatcgtttcttttttatagtgttctctgatgccatctgctggattcctgtatttgtagttaaaatcctttccctcttccgggtggaaataccagacacaatgacttcctggatagtgatttttttccttccagttaacagtgctttgaatccaatcctctatactctcacaaccaacttttttaaggacaagttgaaacagctgctgcacaaacatcagaggaaatcaattttcaaaattaaaaaaaaaagtttatctacatccattgtgtggatagaggactcctcttccctgaaacttggggttttgaacaaaataacacttggagacagtataatgaaaccagtttcctagcaatcattttggatcactggactttcagtggactacctaaaacaggggacagcttttggaagatgacatctgcaatgcttttcatctttaccaacggcaagcctttctgcacagagagcacagcagaatggctcctgtcactgcattccaatggcagctgtactatctaccaaccatgctgaggacagcaccaaaggttcctctcctcaccccacatgcctgaaaagcacatgtgaattcgtgtatagtgggctgaggtgcagctgatctctagctaatcaacacaacccaccaacaaatgaccacaggttggcactgtgtggtctttcacatcgggttgcactgtccatgaaatagaaacactcacaacatctgattccagtgtggccataataacagaaatctaacaactctttccttgccttttcaatatcaaataaaaccatcagcatcctgctggattgata

SEQ ID NO: 5546 - DNA, 2736 bp, Homo sapiens
ggcactgaacttactacatcagaactcctgctgaggtataagaggatacgtctaataactcaattgctgtaaacctatgattgtttttctggtttttaaacatctcttcagcctcagattgattacaatgttctttctacttcatttcatcgttctgatcaatgtcaaagattttgcactgactcaaggtagcatgatcactccttcatgccaaaaaggatattttccctgtgggaatcttaccaagtgcttaccccgagcttttcactgtgatggcaaggatgactgtgggaacggggcggacgaagagaactgtggtgacactagtggatgggcgaccatatttggcacagtgcatggaaatgctaacagcgtggccttaacacaggagtgctttctaaaacagtatccacaatgctgtgactgcaaagaaactgaattggaatgtgtaaatggtgacttaaagtctgtgccgatgatttctaacaatgtgacattactgtctcttaagaaaaacaaaatccacagtcttccagataaagttttcatcaaatacacaaaacttaaaaagatatttcttcagcataattgcattagacacatatccaggaaagcattttttggattatgtaatctgcaaatattatatctcaaccacaactgcatcacaaccctcagacctggaatattcaaagacttacatcagctaacttggctaattctagatgacaatccaataaccagaatttcacagcgcttgtttacgggattaaattccttgtttttcctgtctatggttaataactacttagaagctcttcccaagcagatgtgtgcccaaatgcctcaactcaactgggtggatttggaaggcaatagaataaagtatctcacaaattctacgtttctgtcgtgcgattcgctcacagtgctggatctgtctagcaatacgataacggaactatcacctcacctttttaaagacttgaagcttctacaaaagctgaacctgtcatccaatcctcttatgtatcttcacaagaaccagtttgaaagtcttaaacaacttcagtctctagacctggaaaggatagagattccaaatataaacacacgaatgtttcaacccatgaagaatctttctcacatttatttcaaaaactttcgatactgctcctatgctccccatgtccgaatatgtatgcccttgacggacggcatttcttcatttgaggacctcttggctaacaatatcctcagaatatttgtctgggttatagctttcattacctgctttggaaatctttttgtcattggcatgagatctttcattaaagctgaaaatacaactcacgctatgtccatcaaaatcctttgttgtgctgattgcctgatgggtgtttacttgttctttgttggcattttcgatataaaataccgagggcagtatcagaagtatgccttgctgtggatggagagcgtgcagtgccgcctcatggggttcctggccatgctgtccaccgaagtctctgttctgctactgacctacttgactttggagaagttcctggtcattgtcttccccttcagtaacattcgacctggaaaacggcagacctcagtcatcctcatttgcatctggatggcgggatttttaatagctgtaattccattttggaataaggattattttggaaacttttatgggaaaaatggagtatgtttcccactttattatgaccaaacagaagatattggaagcaaagggtattctcttggaattttcctaggtgtgaacttgctggcttttctcatcattgtgttttcctatattactatgttctgttccattcaaaaaaccgccttgcagaccacagaagtaaggaattgttttggaagagaggtggctgttgcaaatcgtttcttttttatagtgttctctgatgccatctgctggattcctgtatttgtagttaaaatcctttccctcttccgggtggaaataccagacacaatgacttcctggatagtgatttttttccttccagttaacagtgctttgaatccaatcctctatactctcacaaccaacttttttaaggacaagttgaaacagctgctgcacaaacatcagaggaaatcaattttcaaaattaaaaaaaaaagtttatctacatccattgtgtggatagaggactcctcttccctgaaacttggggttttgaacaaaataacacttggagacagtataatgaaaccagtttcctagcaatcattttggatcactggactttcagtggactacctaaaacaggggacagcttttggaagatgacatctgcaatgcttttcatctttaccaacggcaagcctttctgcacagagagcacagcagaatggctcctgtcactgcattccaatggcagctgtactatctaccaaccatgctgaggacagcaccaaaggttcctctcctcaccccacatgcctgaaaagcacatgtgaattcgtgtatagtgggctgaggtgcagctgatctctagctaatcaacacaacccaccaacaaatgaccacaggttggcactgtgtggtctttcacatcgggttgcactgtccatgaaatagaaacactcacaacatctgattccagtgtggccataataacagaaatctaacaactctttccttgccttttcaatatcaaataaaaccatcagcatcctgctggattgata

SEQ ID NO: 5547 - DNA, 2533 bp, Homo sapiens
ggggagttatgcgccagtgccccagtgaccgcgggacacggagaggggaagtctgcgttgtacataaggacctagggactccgagcttggcctgagaacccttggacgccgagtgcttgccttacgggctgcactcctcaactctgctccaaagcagccgctgagctcaactcctgcgtccagggcgttcgctgcgcgccaggacgcgcttagtacccagttcctgggctctctcttcagtagctgctttgaaagctcccacgcacgtcccgcaggctagcctggcaacaaaactggggtaaaccgtgttatcttaggtcttgtcccccagaacatgacctagaggtacctgcgcatgcagatggccgatgcagccacgatagccaccatgaataaggcagcaggcggggacaagctagcagaactcttcagtctggtcccggaccttctggaggcggccaacacgagtggtaacgcgtcgctgcagcttccggacttgtggtgggagctggggctggagttgccggacggcgcgccgccaggacatcccccgggcagcggcggggcagagagcgcggacacagaggcccgggtgcggattctcatcagcgtggtgtactgggtggtgtgcgccctggggttggcgggcaacctgctggttctctacctgatgaagagcatgcagggctggcgcaagtcctctatcaacctcttcgtcaccaacctggcgctgacggactttcagtttgtgctcaccctgcccttctgggcggtggagaacgctcttgacttcaaatggcccttcggcaaggccatgtgtaagatcgtgtccatggtgacgtccatgaacatgtacgccagcgtgttcttcctcactgccatgagtgtgacgcgctaccattcggtggcctcggctctgaagagccaccggacccgaggacacggccggggcgactgctgcggccggagcctgggggacagctgctgcttctcggccaaggcgctgtgtgtgtggatctgggctttggccgcgctggcctcgctgcccagtgccattttctccaccacggtcaaggtgatgggcgaggagctgtgcctggtgcgtttcccggacaagttgctgggccgcgacaggcagttctggctgggcctctaccactcgcagaaggtgctgctgggcttcgtgctgccgctgggcatcattatcttgtgctacctgctgctggtgcgcttcatcgccgaccgccgcgcggcggggaccaaaggaggggccgcggtagccggaggacgcccgaccggagccagcgcccggagactgtcgaaggtcaccaaatcagtgaccatcgttgtcctgtccttcttcctgtgttggctgcccaaccaggcgctcaccacctggagcatcctcatcaagttcaacgcggtgcccttcagccaggagtatttcctgtgccaggtatacgcgttccctgtgagcgtgtgcctagcgcactccaacagctgcctcaaccccgtcctctactgcctcgtgcgccgcgagttccgcaaggcgctcaagagcctgctgtggcgcatcgcgtctccttcgatcaccagcatgcgccccttcaccgccactaccaagccggagcacgaggatcaggggctgcaggccccggcgccgccccacgcggccgcggagccggacctgctctactacccacctggcgtcgtggtctacagcggggggcgctacgacctgctgcccagcagctctgcctactgacgcaggcctcaggcccagggcgcgccgtcggggcaaggtggccttccccgggcggtaaagaggtgaaaggatgaaggagggctggggggggccccatttaagaagtaggtgggaggaggatgggcagagcatggaggaggagcctgtggataggccgaggaccttctctggagaggagatgcttcgaaatcgggtggagagaggaaattggcaaagggatagagacgagccccacgggccagacagccaacctccgctccgcaccccacagcctctccttactcttcccacgctgagtagtgtgggggcgcccagaagcgaagacaagcagcaaaaatgtagagaaattggcacggggagcggggcttagccaaatgatgcacagacaattgtgcccgtttattccagcgacttctgcggagagggcagccgtcggcacaaacactcctttgcgtcttggcaaacgagactgcagcagcgccaaggtcctacttgctgcggggctgccccaggaatctagagctggtaggcaagaaacgcttttggagttaagaaaaagaactgaccatcctggtccgcccacaggagaaacggcaaaggaaagccacctccaatggagtcattatgacaattatcattccggactgggccagcgggaacaccctgagcccgacctagctgcacagccccggagctcagacgttagcagggggataacacctgtcaccagcttgggagagccattctctggggagtgtcgtcgctgcg

SEQ ID NO: 5548 - DNA, 1146 bp, Homo sapiens
accaatctctgatgccctgcgatgcccacactcaatacttctgcctctccacccacattcttctgggccaatgcctccggaggcagtgtgctgagtgctgatgatgctccgatgcctgtcaaattcctagccctgaggctcatggttgccctggcctatgggcttgtgggggccattggcttgctgggaaatttggcggtgctgtgggtactgagtaactgtgcccggagagcccctggcccaccttcagacaccttcgtcttcaacctggctctggcggacctgggactggcactcactctccccttttgggcagccgagtcggcactggactttcactggcccttcggaggtgccctctgcaagatggttctgacggccactgtcctcaacgtctatgccagcatcttcctcatcacagcgctgagcgttgctcgctactgggtggtggccatggctgcggggccaggcacccacctctcactcttctgggcccgaatagccaccctggcagtgtgggcggcggctgccctggtgacggtgcccacagctgtcttcggggtggagggtgaggtgtgtggtgtgcgcctttgcctgctgcgtttccccagcaggtactggctgggggcctaccagctgcagagggtggtgctggctttcatggtgcccttgggcgtcatcaccaccagctacctgctgctgctggccttcctgcagcggcggcaacggcggcggcaggacagcagggtcgtggcccgctctgtccgcatcctggtggcttccttcttcctctgctggtttcccaaccatgtggtcactctctggggtgtcctggtgaagtttgacctggtgccctggaacagtactttctatactatccagacgtatgtcttccctgtcactacttgcttggcacacagcaatagctgcctcaaccctgtgctgtactgtctcctgaggcgggagccccggcaggctctggcaggcaccttcagggatctgcggttgaggctgtggccccagggcggaggctgggtgcaacaggtggccctaaagcaggtaggcaggcggtgggtcgcaagcaacccccgggagagccgcccttctaccctgctcaccaacctggacagagggacacccgggtga

SEQ ID NO: 5549 - DNA, 1326 bp, Homo sapiens
actcgatcagcccgccggctccggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccggacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaagcgaatgctgatgtcttaaaggcgatggtagcagataacagcctgtatgatcctgaaagccccgtgacccccagcacaccagggagcccgccagtgagtcctgggcctttgtcaccaggggggacgccagggaagcacgtctgtggccatcatctgcatacggtgggcggtgttgtcgagagggatgtgtgtcatcggtgtaggcacaagcggtggcactttataaagcccactaacaagtccagagagagcagaccacggcgccaaggcgaggtcacggtcctttctgttggcagatttagagttacaaaagtggagcacaagtcaaaccagaaggaacggagaagcctgatgtctgttagtggggctgaaaccgtcaatggggaggtgccggcaacacctgtgaagagagaacgcagtggcacagagtagcagtgtcctgaatgacagctcatctacacagagtgaaactccagatatgtgacaagcagcatgggacagatgctgacaatcagaacagatgctggatgtaaacaactggtaaggctgcactggtgcatgctggcagaatcacctgctatgcatccagggagcaaatgcatctgcatgctcagcatgacaccagcttacctccctgtgcaaatcccctcccctaatcagtctcatccaaatcttctcctgcagtagcagcttctaaagctgcaagggcctccgccaccgctgcatcctcgtccacaatctccccatccccatctccatcggagccatgggtatcctcctgcctgtttcctgagtcaaccacaggcatggcatgaacaggacccttctcattaaagcagatgcttagaacttc

SEQ ID NO: 5550 - DNA, 1350 bp, Homo sapiens
actcgatcagcccgccggctccggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccggacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaagcgaatgctgatgtcttaaaggcgatggtagcagataacagcctgtatgatcctgaaagccccgtgacccccagcacaccagggagcccgccagtgagtcctgggcctttgtcaccaggggggacgccagggaagcacgtctgtggccatcatctgcatacggtgggcggtgttgtcgagagggatgtgtgtcatcggtgtaggcacaagcggtggcactttataaagcccactaacaagtccagagagagcagaccacggcgccaaggcgaggtcacggtcctttctgttggcagatttagagttacaaaagtggagcacaagtcaaaccagaaggaacggagaagcctgatgtctgttagtggggctgaaaccgtcaatggggaggtgccggcaacacctgtgaagagagaacgcagtggcacagagtagcagcaatgacttgacttgaagagctctaagagactgaaaacttatatgaagttgccttgggaatatttttatatattttatacagtttctatcatggagtcagcaggcacgtggataaaacctaaaagggaatattattgctgtgccatatacagaattcagtttgctttgaaacaagttttggttgaaagagtctgttgaaaattttattatacttccagggaaggaaagagctgtttttatcttcttaaccactcccagcctctactcttcccagcccctaatcccaggccttggtgtacacactgtagtttttccattatgatgagtatgtgcagtgatactattcatgtacagtctgagcttatgctcaggggtgtgtgtgtatatgtgtatgcatgtgtgcacgtgagtgtgtgtttctttttccagttcctgcatccta

SEQ ID NO: 5551 - DNA, 1092 bp, Homo sapiens
aggttctccggctccagctcctgcgccgcctgttgctcgctcctccgggcggtcgcttcccgcccggtgcccaggggtaggcggcccgagagcgcgcaggcagccagcctcccgccttcgtcccctccccgtaccgcaggagccggtccgaggggtccggagcgtccctgagagcgcggaccccggcgagcagcccagtgcacccgggactgcgcgccgagacccccggcgccgcgcggcgatgaacgcgaccttcctgaaccacagcggcttggaggaggtggacggcgtgggcggcggcgccggggccgccctgggaaaccgcacccacgggctgggcacgtggctgggctgctgtccagggggcgcaccgctggccgccagcgacggggtccccgcggggctggcgcccgacgagcgcagcctgtgggtgtcgcgggtggcgcagatcgccgtgctctgcgtgctgtcgcttaccgtggtcttcggcgtcttcttcctgggctgcaacctgctcatcaagtccgagagcatgatcaactttctggtgcaggagcgccggccctccaaggacgtgggcgcagccatcctggggctgtactgagcgccatctgggtccgccctcgccagcgctgctgcaagaaggaccccggagacccggaccctcgccccgctctctgcgctctgccgccgcctccgggcgggcagctacgtgcctggggcgcccgggcggggacgcggcgagactgtcggcgggggcgcgggaagggacttggacgcccggctctgtcctgtgtgcgctgcagcgttgcggggtgggagaatgtggggtgagggttcttaccagttttttttgtttgtttgttttttaagacgttcggggcagggtgggagtgggtatggagatgcaatttgggactgcggtcgctcgcgtgggagttttgtgtgtacgttggtgcgggtgggttcggaacacggtgcgagtgggtgaagatgtgaagcgtcagagtcgctgagcttgttggcctgatcttgcgtttggaaagaaatcttgtaataaaactgcagccgtagggcttcaggcagcttccc

SEQ ID NO: 5552 - DNA, 1413 bp, Homo sapiens
atcaactttaaagatattttaaacttgatgaagacttctgaatctatcagaaaacaggttagaatgtctgtcttcaagtcttgattctgaaaagtagcccctgagcctgtttcattttggctgtgtttttattactgtgcagctgacaccccttggaaaggacctaatgcactgcacagcatttgcaacggcagatgagtatcatctgggaaatctgtctcaagatctggcctcccacggatatgttgaagtaacaagcttgcctagaggtacttcttcttgaacctggggccaaatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttca

SEQ ID NO: 5553 - DNA, 1411 bp, Homo sapiens
atcaactttaaagatattttaaacttgatgaagacttctgaatctatcagaaaacaggttagaatgtctgtcttcaagtcttgattctgaaaagtagcccctgagcctgtttcattttggctgtgtttttattactgtgcagctgacaccccttggaaaggacctaatgcactgcacagcatttgcaacggcagatgagtatcatctgggaaatctgtctcaagatctggcctcccacggatatgttgaagtaacaagcttgcctagaggtacttcttcttgaacctggggccaaatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcctggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttc

SEQ ID NO: 5554 - DNA, 1854 bp, Homo sapiens
gagatgggttggctgcagtagtgagaggctgggggtgcggctctttccctgcagtcctgccgaggaagcgtgcgtccctggcgcttccttcttctcttccggcggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttca

SEQ ID NO: 5555 - DNA, 743 bp, Homo sapiens
gggttggctgcagtagtgagaggctgggggtgcggctctttccctgcagtcctgccgaggaagcgtgcgtccctggcgcttccttcttctcttccggcggagaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaac

SEQ ID NO: 5556 - DNA, 1351 bp, Homo sapiens
cggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaa

SEQ ID NO: 5557 - DNA, 1404 bp, Homo sapiens
ccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttgggatgcttctgtttgcggggacggtcggtgcagctgcaaggctggaggcggccggcaggtgcccggtgctggctgcagatgcggcgctaaccttctctccccacttgaaggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaa

SEQ ID NO: 5558 - DNA, 1242 bp, Homo sapiens
gaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatatttt

SEQ ID NO: 5559 - DNA, 522 bp, Homo sapiens
gaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacga

SEQ ID NO: 5560 - DNA, 1348 bp, Homo sapiens
cggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaagccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatatttt

SEQ ID NO: 5561 - DNA, 540 bp, Homo sapiens
gttttatctccctttctgttttgtttgtgaccaggcataaagcagtcaccttcaacagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttct

SEQ ID NO: 5562 - DNA, 2859 bp, Homo sapiens
atggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagaggcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgcgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgttt

SEQ ID NO: 5563 - DNA, 5223 bp, Homo sapiens
ggttccggttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagaggcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgcgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgtttagataaattgttttctgtgttatttcccttcgttcactgtgaggggttgattcatgaggagagccctgggttcctggctcaggtttacttttggccttaggataggattcccttattagagataaatactgctgttctcttctagctcattcattcatttagcagtcaattgctcagtgccaggtgctaggaacagaggctcaatctctaccctcagaaaactcagtgtgacgagagagagcctgacagataaaatgaactatgaccctgtaagagggctcaggatcgtgaatcctgcaggcagagaaacatgagccataatctgtccctgcattttctagctgtggaatcttgggtcagctccttaactggtctgagctttggcttcagggtagtaaagggaggggtattaaaggtcctggttaaatgaaatcatcagtgtgtgtaaaacagcattggttctagctcatacatgataaccactcattaagtggtaattatgtttttattataagggctatgctgtaattcagacatgggcccaaaactacaggaaagataaattgtttttgctaaagtattgccaagaaacttcacagtttcttgggaggtgggccttgaggcatgcaaagaacttcttcaggtaggcaaagaagagaggacactcttggcagaaagagttgttgaaaaaagcagtagggtgtgaaaatacatggatgttcaagtattttggtgaggctgttatgtaaagtgttgttggtctttggggaaaattggcttatggaaattcctgccagaagtactaagcccttatggtggttcttcctgccctagctcttggttggtttatatataaggaatatatttgtgtatttatatatcagacatttggatgtacctttcagttatttaggatttagaaaattctttttggattttccagaattattttatccttcggggatgacagttatatgtgtatatacaacccaggatgacaaaatcatgggtccggtttttgttgccagggctgctgtctcttttcttgcggtcttcatttctcacgagggtgctgggaacttgatcagtcccctggccttttggcactgtggcagagtacacaagtcatacctttatggacagttagctcacaaaacaactgcataatctgggatcactcttggtaaatcaggtgggtggtgcagccaggagatcccctttcctggtcacaacaggagcacaaagaaaccattatctccatgactagctccagaagctgggcccagggagtcgtgatgaggagtggaggtgtatttggcctgtagaatcaacggcctttgagaaccatacaatgcaccttatatggcttgggtgatcaaataacttaaggtccaaattcaaacactttggaaaaagggagctttaatataattatgccaaggtgataggcataaactaagactgtcctggacgtagggtcacccctgtctatagccatttaagatttttgaacctgatgactaaacaaacaaaaccctctttcctttttagaatatcctgtatgcgctatttcccaccagaggcagaggccacaggagataggccatggttcaggtaggaaatgctcttggtcacatcagaactctagatctgggggaataaacaaacccgaattattaccacactctcaaagttctcttcaatctggactatttgtattccaaagaaaaatttagtgctttagctattcagcaatattgagaaaaaacatgaacacatttatgactttgccttgaccattgacttttctaaaatgtgcttccttttcctttatttccctttttttatacaaagaaaatagcccaaatttctcctcttaggtcattccttaacctctcagagaaccagtttccccatgaattgggaataatgctctatttacagggctgtttggattaaataagatgctgtttataaagtgtctgtgccagggcaaagcatgtggtaggtgcttggtgacagcatgatccctgtcaccactctgtcaagtccagtgttgctgagatgtcacacctgacaccctctaaggctaccctgattgccaggagtggcccagggcccttctgcagtctccgggtgcctttagttataacctcttgtctgggtcagaccattagctttcatgtctgcttctagctacaactgtagcctcccttccttttgccttcaaatctgccacagctgcccggcaacaaaaaaagattcctaagcatctcgaggtcctgtttaaatgggttagggtccaagcaagccctgagacatcaagtggttgggtcttttatacctttttcatctctacagccctgttctcttcctaaggccaggcccacaggggatactgaggaaccaccagccccttcaggcggcacagcagaccctgaagagaactgctctaacttaagtaccttctgacttcaccatttttccagcctctgggtgtggttctgatgaaccttaaacttgaaaggcacaggccagaggaaggacagtgttgacccacatgtcattggtgaggttatgatctctttgctattatcacctacttacccacctgaggctcctaggaaacaatgaatgaaaggtatagaaaaaaattaggaagtaaacagggcttttttcccctttatgaaaaaagtacacagaagtgttgaaacgattcaagtttaatttgttgatatatgtgtgtacttagacaaacactaaattctacaacatacataatgtcaacatgggaaaataccaagtttgtcattgcacataccaataaataaatacatttgctccagaataccaaag

SEQ ID NO: 5564 - DNA, 2929 bp, Homo sapiens
agcccgtgctccggttccggttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagaggcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgcgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgtttagataaa

SEQ ID NO: 5565 - DNA, 5272 bp, Homo sapiens
atgtgccgcctgaagagacaagagtttgtgataagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagaggcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgcgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgtttagataaattgttttctgtgttatttcccttcgttcactgtgaggggttgattcatgaggagagccctgggttcctggctcaggtttacttttggccttaggataggattcccttattagagataaatactgctgttctcttctagctcattcattcatttagcagtcaattgctcagtgccaggtgctaggaacagaggctcaatctctaccctcagaaaactcagtgtgacgagagagagcctgacagataaaatgaactatgaccctgtaagagggctcaggatcgtgaatcctgcaggcagagaaacatgagccataatctgtccctgcattttctagctgtggaatcttgggtcagctccttaactggtctgagctttggcttcagggtagtaaagggaggggtattaaaggtcctggttaaatgaaatcatcagtgtgtgtaaaacagcattggttctagctcatacatgataaccactcattaagtggtaattatgtttttattataagggctatgctgtaattcagacatgggcccaaaactacaggaaagataaattgtttttgctaaagtattgccaagaaacttcacagtttcttgggaggtgggccttgaggcatgcaaagaacttcttcaggtaggcaaagaagagaggacactcttggcagaaagagttgttgaaaaaagcagtagggtgtgaaaatacatggatgttcaagtattttggtgaggctgttatgtaaagtgttgttggtctttggggaaaattggcttatggaaattcctgccagaagtactaagcccttatggtggttcttcctgccctagctcttggttggtttatatataaggaatatatttgtgtatttatatatcagacatttggatgtacctttcagttatttaggatttagaaaattctttttggattttccagaattattttatccttcggggatgacagttatatgtgtatatacaacccaggatgacaaaatcatgggtccggtttttgttgccagggctgctgtctcttttcttgcggtcttcatttctcacgagggtgctgggaacttgatcagtcccctggccttttggcactgtggcagagtacacaagtcatacctttatggacagttagctcacaaaacaactgcataatctgggatcactcttggtaaatcaggtgggtggtgcagccaggagatcccctttcctggtcacaacaggagcacaaagaaaccattatctccatgactagctccagaagctgggcccagggagtcgtgatgaggagtggaggtgtatttggcctgtagaatcaacggcctttgagaaccatacaatgcaccttatatggcttgggtgatcaaataacttaaggtccaaattcaaacactttggaaaaagggagctttaatataattatgccaaggtgataggcataaactaagactgtcctggacgtagggtcacccctgtctatagccatttaagatttttgaacctgatgactaaacaaacaaaaccctctttcctttttagaatatcctgtatgcgctatttcccaccagaggcagaggccacaggagataggccatggttcaggtaggaaatgctcttggtcacatcagaactctagatctgggggaataaacaaacccgaattattaccacactctcaaagttctcttcaatctggactatttgtattccaaagaaaaatttagtgctttagctattcagcaatattgagaaaaaacatgaacacatttatgactttgccttgaccattgacttttctaaaatgtgcttccttttcctttatttccctttttttatacaaagaaaatagcccaaatttctcctcttaggtcattccttaacctctcagagaaccagtttccccatgaattgggaataatgctctatttacagggctgtttggattaaataagatgctgtttataaagtgtctgtgccagggcaaagcatgtggtaggtgcttggtgacagcatgatccctgtcaccactctgtcaagtccagtgttgctgagatgtcacacctgacaccctctaaggctaccctgattgccaggagtggcccagggcccttctgcagtctccgggtgcctttagttataacctcttgtctgggtcagaccattagctttcatgtctgcttctagctacaactgtagcctcccttccttttgccttcaaatctgccacagctgcccggcaacaaaaaaagattcctaagcatctcgaggtcctgtttaaatgggttagggtccaagcaagccctgagacatcaagtggttgggtcttttatacctttttcatctctacagccctgttctcttcctaaggccaggcccacaggggatactgaggaaccaccagccccttcaggcggcacagcagaccctgaagagaactgctctaacttaagtaccttctgacttcaccatttttccagcctctgggtgtggttctgatgaaccttaaacttgaaaggcacaggccagaggaaggacagtgttgacccacatgtcattggtgaggttatgatctctttgctattatcacctacttacccacctgaggctcctaggaaacaatgaatgaaaggtatagaaaaaaattaggaagtaaacagggcttttttcccctttatgaaaaaagtacacagaagtgttgaaacgattcaagtttaatttgttgatatatgtgtgtacttagacaaacactaaattctacaacatacataatgtcaacatgggaaaataccaagtttgtcattgcacataccaataaataaatacatttgctccagaataccaaagtttattcaaaaagtcaataaaagcacagttttgcaaatttgtc

SEQ ID NO: 5566 - DNA, 1300 bp, Homo sapiens
ggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaaggtaagtagaatcatcctaatcatattacatcaatgaaaatctaatatggcaataaaaatcattgtctacattaaaacttcttatagttcataaaattatttcaaatccatcatctctttaaatcctgcctcctcttcatgaggtacttaggatagccattatttcagtttcacataagaaatgtttactcaatgtttaagtgttttgccccaaaattcacaactaacaaggcagaactaggacttgaacatggatcttttggttcttaatccagtgagtgatacaattcaatgcactcccctgccaaaaaaaaaaaaaaaaaaaaaaaaattaacatctttacaggccgaaaaggaataaagattttctaagaagagcttttattattgggattggcacagtgatttccaaatagccattgtaaggccaaataatgacaccactttatcctgcttgtttctccacaggaatttgagatgctgtttttaatattatctccaataattctcctgagacagaactgtccctcctgaaattaagcctgatatttcctagctctggggagacatgggtgtaggttctttaaagcagacccccagttgagttccacctccaggcaggcctttgcaggcccctggcccctgtactgtgaattagaggcagaagactcactttgccctcctgtctagagtaagcttaaataagatgagttctttctcgcccaggaattctgcaggcagtctgagttgagtctgtaagaatgcccatagggtgccacacatcccttttagatgagcatgagcaaggaagatgacctgtagggagattttttttcccttgtgttagaaatgcttgttctctggtgccataaagaagcagcacttggacgtacatttaatttcctcagcaaggc

SEQ ID NO: 5567 - DNA, 1211 bp, Homo sapiens
gcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaagaaaactaagagtgagaactgacaaaaagccattggatttgacggttaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagt

SEQ ID NO: 5568 - DNA, 1031 bp, Homo sapiens
gaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagtacccagacagaccatagtgatgtttacgtccattgcctaggagtatttaccactaaatggttggattgtctgatatttctaagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagtctgaagtatccattactcaagtcccaag

SEQ ID NO: 5569 - DNA, 867 bp, Homo sapiens
atggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattagttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtga

SEQ ID NO: 5570 - DNA, 2702 bp, Homo sapiens
gcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccagggatggccacctccccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 5571 - DNA, 3703 bp, Homo sapiens
gggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcggggccgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 5572 - DNA, 3207 bp, Homo sapiens
gggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaaggcacccgaaatgtgagatttgatggagaacataaagctttgacattaaactagttatagcgttgacagaaaacagaagatcatgcttgccagtaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaacattaatcttatcactggtcatttagaggaaccaatgccaaaccccatagatgaaatgacagaagaacaaaaagaatatgaagccatgaaacttgtcaacatgcttgataaactttccaggagagcagatgtgaaggacctgcaccaggatggtggttagcaacagtggcccgtgccaaagcacttaccaaagtgatgatgactaagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaa

SEQ ID NO: 5573 - DNA, 5131 bp, Homo sapiens
cgggcggaggctggcgggttggaggcaggacggagggagggaaagagggaaggaaggaagctgggaaggagcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaacattaatcttatcactggtcatttagaggaaccaatgccaaaccccatagatgaaatgacagaagaacaaaaagaatatgaagccatgaaacttgtcaacatgcttgataaactttccagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggccatctgtgtgtgtttctttatagatacatgggctaaacaatactatttcacagtttatgcttttttaaagtgcttttacatccatggtcccacttctaatagcctttttaaggacaggtagagtacatggagggttactgaaaaggtcatttatccagaagttacctctctggcaaagcaaaaaaatcaggaattacgtcttaaaggcctttcagctgccagaggagatgtcacaaagtttcttgcaacttacttatgggagagatcttcaagaatatcactcttagactctgaactgaaatttgcatacgcttccaacatgttttattagctggctttgaagctcacaaaagaatggcaaagaaagaggctgctagattgaaggcaggcatactgaaagaagaaaaaggccaactgaaaactagatagtgagatgagaagaataaaacttcaagacatagcaaatctgggactgtctacttaccaaaggatactctagttgacccagaaaatgtgtgtacaacagtatggcccgtagactacttcctataatggtgaccctgagtttttttaaaagaagaaattaaatccagaacgctttataaaagggtaggaagaagacaatagatgttagaatttcatccaaaatgtttgagggagaggtgagtgacccaggttttaaccaacagcaaaagaaatgggcaattcataattttagattaagtgaaaagtttagaaaaaatttaagtatttttgttattctacaaatgcatttttaaagtatttttataatttctataatcaaatagctttggcatgcatgtcagcttacctaaatgaagatgtgtttaatgaaatgccatcttaccagctttctttatgcagagtaagtgtttgaacagtcctgtttcagtagctgtgctcttctgctttcagtgagttctgtttcattttgcatttctctgcactgggcactaagctttgtttttgaaaagagagtttgcggggaagaagatgagagtgtcttcatctggcacacagaaagagaactaatatctgttaagtgcttactacatgctgggcttttgatgtatgttatctcatgtaacctcaccttatcgcatatgaaagatcctctccagaaagcttatgaaagttaccccacgtcacagcaaggaagagtccaactctggtggcctgactcccagcaccactccttccttttccccacagcacacctgggcccacactgtgcctccttagggctctgaaatgctgggaacagagtggtgtgaggagggtggtcattctcaggccattttaagcaataactatttcaacagaactagtttaaagaggtttttaagcagggaagtgacctgaagtggaagtatgagtgggaaacttgcatggtcagcactggatttccaatgaagacctggaatccgttaggataggccagggaccaaggctgcaggctggcctctctgcccacaactctcctgaccttggaagcagggtacggaggcgtgtgtcctaaaataaagcatttgagctgctgctacagaggaacaatcaccagatattgtgaccctttcagatgcccagtagtcctgggaggcaggcagggcaggtgttattatcccttctttataaatgaggacacagaatgaggcagtacaagtgactctaaacacccccttagtgccacatcagtctcgccacctcccaggactaggtgtcacctgtattgacctcttcccctctgattataaaagtaatatatgttcattgtggaaagtttggaaaatgcagaaaataaaattaataatttaccccaaatcccaccatcctgagatcatcactgttaatgttttagtgtatttccttcctgtattttttctatgcatatataatttattttactacaagattgggatcatgctgtatttacagatttgtatcctgctttctttaacatattgtgagcattttcccatgtcaataaatattcttcaaaaa

SEQ ID NO: 5574 - DNA, 2440 bp, Homo sapiens
agggaaggaaggaagctgggaaggagcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaaagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtg

SEQ ID NO: 5575 - DNA, 1853 bp, Homo sapiens
tttttgtttatttttgttttgttttgttttgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggg

SEQ ID NO: 5576 - DNA, 3157 bp, Homo sapiens
cggcggccccgtggccaacatgcttcgcaaagggtgctgtgtggagttgctgctgctgttggtagctgcggagctgcccctgggtggtggctgcccacgggactgtgtgtgctacccggcgcccatgacggtcagctgccaggcgcacaactttgcagccatcccggagggcatccccgtggacagcgagcgcgtcttcctgcagaacaaccgcatcggcctcctccagcccggccacttcagccccgccatggtcaccctgtggatctactcgaacaacatcacctacatccaccccagcaccttcgagggcttcgtgcacctggaggagctggacctcggcgacaaccggcagctgcggacgctggcacccgagaccttccagggcctggtgaagcttcacgccctctacctctacaagtgtgggctcagcgccttgccggccggcgtctttggcggcctgcacagcctgcagtacctctacctgcaggacaaccacatcgagtacctccaggacgacatcttcgtggacctggtcaacctcagccacctgtttctccacggcaacaagctgtggagtctgggcccgggcaccttccggggcctggtgaacctggaccgtcttttgctgcacgagaaccagctgcagtgggtccaccacaaggcgttccacgacctccgcaggctgaccaccctcttcctcttcaacaacagcctctcggagctgcagggtgagtgcctggccccgctgggggccctggagttcctccgcctcaacggcaacccctgggactgtggttgtcgcgcgcgctccctgtgggaatggctgcagaggttccggggctccagctccgctgtcccctgtgtgtcccctgggctgcggcacggccaggacctgaagctgctgagggccgaggacttccggaactgcacgggaccagcgtccccgcaccagatcaagtcacacacgctcaccaccaccgacagggccgcccgcaaggaacaccactcaccccacggccccaccaggagcaagggccacccgcacggcccccggcccggccacaggaagccggggaagaactgcaccaaccccaggaaccgcaatcagatctctaaggcgggcgccgggaaacaggcccccgagctgccagactatgccccagactaccagcacaagttcagttttgacatcatgcctacggcccggcccaagaggaagggcaagtgtgcccgcaggacccccatccgtgcccccagcggggtgcagcaggcctcctcggccagttccctgggggcctccctcctggcctggacactggggctggcggtcactctccgctgaggacccagggcgtcagcacccagcactgccacatgtccaccaaggaacagaatttattttcttctttttttaacaagtggaagatctgctgggtttcaggaaaaggctggtagagccttcggctgctgtctggacgtctggaccctgccatgtggattataaacccaaagtgtacagccctaggcgggagggggtggcgcttctcagccggctgtcccagccagccccgcagagcgcccacggacagtgtccactctggcaaggtgggaaaaggcactccaagtgcatcctccactggcaacagtgggacaattgcccccgacggcggcaccggggctctgtggaatcccgatcgttccgagaggtctggagggccccgtggttcctggagaaagcaggacgcagagaagaacaaatgaggctcacccacgaggctgggtggccagcagtctgggcacacacgagcaggtggcatcttggctcttgcctgaggccagtcaccctgccctgaattctatcctactccaccttcagcccctccctcgggggtagcgcctctcattcctgatgtctcaggcaaccctggcagacccaggtccaactgctggggtccaagaaccaattaccaaaggaaagatcatcagaggctgaaatctagaacttcatcccgggcaatgaggttctcacagaaggtgcagttttataactaactacgtccacttatatatattcacactctacatatatatatatatatatatatatatatatatatatatatatacacaaatgcacagtccccctcccactccgttacctaactgtacgtcttttcatgtttataaactatacagaaaactgtatttgctgaactaaggattgtattggtgatttctagcaaaaacaaagtgatagaatttttgtctagaatcccaaactggcaacgatagtctccaagggacctggccttgccaagggcctggggcaaggtgtcggcgggacggtgaggaagggggaggcagcaagagtcactttgggggaccaatattcttagatatttagagcatcaccttgtttttatatgcaacacaagcctgtctgccaccctggagcgccctgtcacccctgctgtcgtagctgttggcttcagggtgagaagtgagaagcagcttattgtatatgagggagccaggccccgagggtgagcgagatggagaaggggaaggaaggggctttgggatctggaaaccagcaggccaggcagcatccacagtgttagtccaaagggtcggaccgtgtcgtcagcctagcgtttggtcagtgacggcctggacgggccaaggagactccgggcttgagcccaggcctcccgcacggctcagctgctgaatttttccttgaggctgtttggtgtgtgacccagcaagggccctgtgtgggacagcaggagggaggcgtcgggggccttagcagaaggggaacaatgagggcatttcatgaaccatctcaggcacttctgcatcacggaagacctggccctcccagccgtcctggggatgctcagggtgcaggcagaggctcgggaggccggactcaggggtcagaagcagggactggggcaggcgagcccggacagggaagaggggctccgatcaaagccggccgtgctgctggccgggggcccaggtgggtacaagctcctttgtgctttgcacaaacctgaatcccccaccagagaggatgtgtgtgaggagccagaaacgctgaatccaattaagagagaaaaataataataacaataaatgatcttgg

SEQ ID NO: 5577 - DNA, 2203 bp, Homo sapiens
tgggcacacggacagacggactgacggactctcgagcggacagcgcagctagcggggcgcgggcgctgggcgtcgacggccagccccagccttccccgccccgtcgcgccccgccccgtcccgtcggggccgatggctcctcccgaggcccgcagcccgggcggcgcagggtagagcgccgcggcccggccacgcagcccggggactcccgggccctcccggagccccgcggggtccccgccgtgcatccggcgggctcagggagcgagtgggagcgccctccccccgctgccccctcccccgagcatcgagacaagatgctgcccgggctcaggcgcctgctgcaagctcccgcctcggcctgcctcctgctgatgctcctggccctgcccctggcggcccccagctgccccatgctctgcacctgctactcatccccgcccaccgtgagctgccaggccaacaacttctcctctgtgccgctgtccctgccacccagcactcagcgactcttcctgcagaacaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctgcatttgtaccgctgccagctcagcagcctgcccggcaacatcttccgaggcctggtcagcctgcagtacctctacctccaggagaacagcctgctccacctacaggatgacttgttcgcggacctggccaacctgagccacctcttcctccacgggaaccgcctgcggctgctcacagagcacgtgtttcgcggcctgggcagcctggaccggctgctgctgcacgggaaccggctgcagggcgtgcaccgcgcggccttccgcggcctcagccgcctcaccatcctctacctgttcaacaacagcctggcctcgctgcccggcgaggcgctcgccgacctgccctcgctcgagttcctgcggctcaacgctaacccctgggcgtgcgactgccgcgcgcggccgctctgggcctggttccagcgcgcgcgcgtgtccagctccgacgtgacctgcgccacccccccggagcgccagggccgagacctgcgcgcgctccgcgaggccgacttccaggcgtgtccgcccgcggcacccacgcggccgggcagccgcgcccgcggcaacagctcctccaaccacctgtacggggtggccgaggccggggcgcccccagccgatccctccaccctctaccgagatctgcctgccgaagactcgcgggggcgccagggcggggacgcgcctactgaggacgactactgggggggctacgggggtgaggaccagcgaggggagcagatgtgccccggcgctgcctgccaggcgcccccggactcccgaggccctgcgctctcggccgggctccccagccctctgctttgcctcctgctcctggtgccccaccacctctgactgcggtgctgagatcgaagaggccagtgtccgatccccgcttcccgtccacccggggctgcggctccggccccagtcgccccaccttccctggccttgctgcctccctttcccctcccagctcctctcctccccggggagcaggccgcctctccttgcctgccccctgggctgtcctgacttgtggcagccccaagagggcgtgtgtggtggctcagccctgccctccccagttctggccattaactcttccccatcccaaggctggggtggggccccccaggcagccgctgacccgcactcctaagggcccacagcggacaccagaggggcttttgtctgcagagcgtcttccaccagcagagcctttggaagctcccccagggagccccacccaggaccctttgggggatgcctcagtcagggccaggctgaccctgacccctgcttaccctagtcccctcaacctcctgacactggaggaatacttttctcctaagtctaccctggacactttttagggcacctggagagaactttcctctccactgtggcccctgcgtggtgaagatcaaaagaagttgtttgggaaaaaaaatttattaaaaaattctattatttta

SEQ ID NO: 5578 - DNA, 1455 bp, Homo sapiens
attatgaagggtgtttcggtatcttccctccaaaatgctaagaaataatttaggcaacagttcagactctaaaaatgaagatggctcggtcttttcacagactgaacacaatattgttgcaacttacttgattatggcaggtatgataagtattatcagcaacataatagttctgggcatcttcattaagtacaaggaacttcggacacccacaaatgcaattattattaacctggctgttactgatataggggtcagtagcattggctatcccatgtctgctgcctcagatctgtatggaagttggaaatttggatacgcaggctgtcaggtttatgctggattgaatattttttttggaatggcaagcattggattactcacggtcgtggctgtggaccgatacctgaccatctgccttcctgacgtagggagaagaatgaccaccaacacttacatcggcttgattctgggagcctggatcaatggcctgttttgggctttgatgcctatcatagggtgggctagttatgccccagatcctactggtgctacgtgtaccataaactggaggaaaaatgatagatcttttgtgtcttacaccatgacagttattgcgataaattttattgtgcccttgacagtgatgttttactgctattaccatgtcacgctatccattaaacatcacactaccagtgactgcactgagtccctcaacagagactggtcagatcagatagatgtaacaaagatgtctgtgatcatgatctgcatgtttctggtggcatggtccccttattccatcgtgtgcttatgggcttcttttggtgacccaaagaagattcctccccccatggccatcatagctccactgtttgcaaaatcttctacattctataacccctgcatttatgtggttgctaataaaaagtttcggagggcaatgcttgccatgttcaaatgtcagactcaccaaacaatgcctgtgacaagtattttacccatggatgtatctcaaaacccattggcttctggaagaatctgaaataagataaaaggacacactatcaaaacactttagttttttgacaatgcttttcttttaaatatgagcccatttagatcaagtgcagacatggatcattgtcctatgagagtgtaagctcctcaagcacagctcgtgcttctgtttgtgcactctggctgctgtagtgtatgcttctctgtgtcctgatatatcaacttattgctcatctcctttgatgaattaggcatcagaggttaaggtcccctttctttctccctattatggcatgcattacactgtactgatgacctttaacttgcctggctcctccattagaataaaagcagtcactaatttaatgttagaataaatgaataattctagataattactgaaatgagttgttggatgttcccagttagaat

SEQ ID NO: 5579 - DNA, 958 bp, Homo sapiens
gcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaaggtatatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacagtgtcaccagtaaatgcttcagatatccactggtcttcttctagtctaccagatagatggatcatcctgggggcattcatcctgttagttttaatgggaattgttctcatctgtgtctggtggcaaaatggtgagtggcaggctggtctctggcccttgaggacgtcttagtctggtaaggactcaagagaggtgaatcatggg

SEQ ID NO: 5580 - DNA, 817 bp, Homo sapiens
gcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatgtacaacagtgacaacaacatggtcaaacctctgggcctcctggggaagaaggtatatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacagtgtcaccagtaaatgcttcagatatccactggtcttcttctagtctaccagatagatggatcatcctgggggcattcatcctgttagttttaatgggaattgttctcatctgtgtctggtggcaaaatggtgagtggcaggctggtctctggcccttgaggacgtcttag

SEQ ID NO: 5581 - DNA, 743 bp, Homo sapiens
gcccagcttcctgcctgttactctccacagtatgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaagatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacagtgtcaccagtaaatgcttcagatatccactggtcttcttctagtctaccagatagatggatcatcctgggggcattcatcctgttagttttaatgggaattgttctcatctgtgtctggtggcaaaatggtgagtggcaggctggtctctggcccttgaggacgtcttagtctggtaaggactcaagagaggtgaa

SEQ ID NO: 5582 - DNA, 875 bp, Homo sapiens
atgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaaggtatatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacaggtaactgagctgggtgggagaatgtggcagctccctttaaaggtcaaaagccttccctgtgtgggtgtcagtgtgtgtgtgcgatagaaaatttgattgacttctccgtgggcttcctgtctggagagtcagtgatggctataaggatttcccaccatcctccctttcccatcccacctcccactgtttcttcctcagtgtagaaaccccttcccattaaccaatgatccagtcacaatgacccactgctaaa

SEQ ID NO: 5583 - DNA, 643 bp, Homo sapiens
acagagactctgaggaagcagtcacctcaggcctctccatcctagagacggcagaaggacaaacatctcctgctggcacaaggaagtcataactcatgtgagtggagccatgtgggattaagaagtgataggagagcttgctgtctgtctctgctctccactgtgtgaggatacaacaggaagacagccatctggtgaggaagagagggccctcgccagataccggacctgctgacaccttgatcttggacttcccatcttccaggaaggcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaagg

SEQ ID NO: 5584 - DNA, 2099 bp, Homo sapiens
cctaattctcaaggtgatgctatttaggaagtcataactcatgtgagtggagccatgtgggattaagaagtgataggagagcttgctgtctgtctctgctctccactgtgtgaggatacaacaggaagacagccatctggtgaggaagagagggccctcgccagataccggacctgctgacaccttgatcttggacttcccatcttccaggaaggcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaaggtatatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacaggcagaagatccacctagaggtgataccacggcggcgcagagttgttcacctgtggtcctcgatcgctgacagccttggctcccactgctgtgtgttccctgagtcaagtggaggcggagcctgcaatgagcggagatcgcgcctctgcattccagtcttggcaacagagcaagactccgtctcaaaaaaaaaaaattttttttcagtacatattttttaaaagatagggctgggcacagcagctcacatctataatcccaacactttgggaggcctaggcaggaggatcacttgagcccaggaatctgaagctgcagtgagcctttgctcgtgagattgtggacctatgatcctaccaccagcccacctggttctaacaccccctcctctatgtgtgagagggagagaagaaaagtgagggagaaaagagagataagcaaagaacagagaggaaaaatggaaaataagaggaaattgggggaattaaacagaggggagggcatggatccccgggagttagaagagtagcagcttgtggattactacgcagtggaggaagaagagttgttggaaattatttgagaggtagtataatcatttgtgaggcagttttctgcattcaccatttctcacagactaagttactcataagcaaacgtgcaattcacattacactgaaattcttccctaatacatcatttgcattggaataaagtacggttttcaaacaacctgatatagcagaactgactgtataaattatgtgagcacagtgcaagtaattctttgtttgtttgtttgtttttttgagacagagtctcactctatctcccaggctggagtgtagtggtgcgatcccggctcactgcaacctcgatctcccaggctcaagcgattcccctgcctcagcctcctgagtagctgggattacaggcatgagccaccacgcccggctaatttttgtatttttagtagagacggggtttcaccctgttggccaggctggtctcgaactacggacctcaggtgatctgcccccctcagcctctcaaagtgctgggattatagcatgagccactgagcccagacacaagtagttctttctgataaacactttaacactgaatgca

SEQ ID NO: 5585 - DNA, 1107 bp, Homo sapiens
cctgcgagccgccaggtgatccacgggctgggcttcgcttctgctgtcccctgcgatccaactccccaatggcagcggccgccagccccgcgttccttctacgcctcccgcttctgctcctgctgtccagctggtgcaggaccgggctggccgaccctcactctctttgctatgacatcaccgtcatccctaagttcagacctggaccacggtggtgtgcggttcaaggccaggtggatgaaaagacttttcttcactatgactgtggcagcaagacagtcacacccgtcagtcccctggggaagaaactaaatgtcacaacggcctggaaagcacagaacccagtactgagagaggtggtggacatacttacagagcaactgcttgacattcagctggagaattacatacccaaggaacccctcaccctgcaggccaggatgtcttgtgagcagaaagccgaaggacacggcagtggatcttggcagctcagtttcgatggacagatcttcctcctctttgactcagaaaacagaatgtggacaacggttcatcctggagccagaaagatgaaagaaaagtgggagaatgacaaggatatgaccatgtccttccattacatctcaatgggagactgcacaggatggcttgaggacttcttgatgggcatggacagcaccctggagccaagtgcaggagcaccacccaccatgtcctcaggcacagcccaacccagggccacggccaccaccctcatcctttgctgcctcctcatcatgtgtctcctcatatgctccaggcacagtctgacccaaagccatggccaccaccctcagtccctgcagcctcctcctcatcctcccctgcttcatcctacctggctgctgaggagagtcctttggagtgacagctaccaaatagcgaagcgccccttgtctggtggacacgtgactcgcgtgactttacctatcattggagacgactcacactccttaccctgccctcttgccttgtatacaataaataacggcgcagccaggtattcggagccactacaggtctccatatcttgatggttccctgggcccagctgtcttttcttccgtc

SEQ ID NO: 5586 - DNA, 3022 bp, Homo sapiens
ctaagaaaggtagttcaggcagagttcagggaagatatctctgtgcagggccagacatggggatgagattctgataatttgggaatgaatcaggcccccagcccctcctccctcagactcagcagtccaggcacccggccctcctccctcggacccagaagtccatgctcccagcccctcctcccttggacccaggagtccaggcccccagcccctcctccctcagacccaggagtccaggcccccagccgccttctcctgcaggaccccaggagcttgggtacccacaggctactagatccttgtttctgtgcatggaaattctcaaattatctccaaaagtctatgaagaaggtaaacacacatttccagatgagggaataggctgatatagttgaaagacacacagagggtcacagtctggaattgacagtggtgggattcgaacctatttcactccagaactgcgtagcgccttatacgctgcggcaagtgtgacgtcattcgaacaaaccataggccccgcccccggactagccacgcccacaggctcctgaaaccaccaatcccagctgtgacagcgctcaggaccgatgctcataggtcccgtccctaggatccccgccccctccgcccgcgccccgcccctcgcagcccagttccggacgcgggcccagccgcgcctgcgcctccgctcgcctgtggctgcgtcgcgcgctcttcctcggagctacccaggcggctggtgtgcagcaagctccgcgccgacccctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggtgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctgatgggaggccaaacggtggatccagaacagagtcagcaaaagtagagcatgtggaccacgctgcccgcttctggtgcctgaagcagacatcactaatcgatcgttcttctgaggattgtctgttcatcccaggtggtctagtctgcctggatcagatgtccttccctgctgctgttgggcaggcagctcagccttttggctccagccagctctggtgtgactgtcaacgccctgcaccccggcgtggccaggacagagctgggcagacacacgggcatccatggctccaccttctccagcaccacactcggtgagtcccctcccagcctggggtctccacgtggagccctccacccctgctttctcagcccagggcccaggaccctccctcagagaccgtccctgaggcctcatgcctgctcctcgcctacgtcttctgaggcacagagcacaggtccctttcctccgttgacctggcctgccagcctctaacagccccgggaagcaggcagagccctgctggcggatgagaaaaccgtgtctcagaggaagaggccgtggagctgacgcctggagtcaggctgtactcaggggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcattt

SEQ ID NO: 5587 - DNA, 2004 bp, Homo sapiens
aggtgtgagacagtcacgttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatttcactctgtcgccaggctggaatgcagtagggcaatctcggctcactgcaacctccacctcccgagttcaagtgatgctcctgcttcggcctcctgagtagctgggactacagggactatgtcaccggtggggcttgccccagcaaggccaccatccctgggaagacggtcatcgtgacgggtgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcattt

SEQ ID NO: 5588 - DNA, 1912 bp, Homo sapiens
gatccccgccccctccgcccgcgccccgcccctcgcagcccagttccggacgcgggcccagccgcgcctgcgcctccgctcgcctgtggctgcgtcgcgcgctcttcctcggagctacccaggcggctggtgtgcagcaagctccgcgccgacccctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggtgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcattt

SEQ ID NO: 5589 - DNA, 1587 bp, Homo sapiens
gacccgccgcgccccagcgttctccgcgtacaggtggtctcttgggttccggtaaggcggcggctgcggaactcccgtggaggggccggtgggccctcgggcctgacgatggcagtggccactgcggcggcagtactggccgctctgggcggggcgctgtggctggcggcccgccggttcgtggggcccagggtccagcggctgcgcagaggcggggaccccggcctcatgcacgggaagactgtgctgatcaccggggcgaacagcggcctgggccgcgccacggccgccgagctactgcgcctgggagcgcgggtgatcatgggctgccgggaccgcgcgcgcgccgaggaggcggcgggtcagctccgccgcgagctccgccaggccgcggagtgcggcccagagcctggcgtcagcggggtgggcgagctcatagtccgggagctggacctcgcctcgctgcgctcggtgcgcgccttctgccaggaaatgctccaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttagaaggcacaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtacaaattcttaa

SEQ ID NO: 5590 - DNA, 2405 bp, Homo sapiens
atcacccattttctgcatcagtcacactgggagctgcagaccggagctgttcctatttgcccatcctctccctgctttctttacctctgaggttggattctccctgtgggatcctgcaatccttctgccccaaaaaactattatagcaggagggaacctgttcctgctcactctttgccttctccttctcatcctagacagcctgaccgtgccctagttttcagaggagtgattgattctggggtgcggagcaggatgaggaaactcaggctcagagagggatttccacctaatgtgcctggaaaccatgggtagctacccaataaggcctttctatgttcagaaggtcatggaccaggagtgttggtatcggagctttgtagagacagttttgacccctgtacttagagcagaggggtgtgtttgccatggagagtgtgtgtgggcagctgtgtgtaagcctgtgtgagttctgtgtatgttcctgtgtgaatatatgtgtgtgctccttcatggacacagcatgcatgtagtgggcatagcaaggcagagagaaatcaggagactaggggcacattgcccagtaggaagatagtatcttcctactgggcaggacttgaggtgtgcaaaggtgtgcatgagtactgcaaaagcagttcaaagagcagagaggtggggccagaataaatatgttgcagaaaggcagtcatcagggaggaaagtgaggattccctgccaaaatgcctgagggcttccctgcctaccacagccctctgtgttcttaaatcctcctgtctgaacagaggccagactctggtttcccccacagcctgtctgtgtctgtcctctgcaaagccatgtggctctacctggcggttttcgtgggcctgtactaccttctgcactggtaccgggagaggcaggtgctgagccacctgagagataagtatgtgttcatcacgggctgtgactctggcttcgggaaactgctggccagacagctggatgcacgaggcttgcgggtgctggctgcatgtctgacggagaaaggagccgagcagctgaggggccagacttcagacaggctggagacggtgaccctggatgttaccaagacagagagcgttgctgcagccgcccagtgggtgaaggagtgcgtgagagacaaaggactctggggcctggtgaataatgctggcatctccttgcccacggctcccaatgagttgctcaccaagcaggacttcgtgaccatactggacgtgaacttgttgggggtgattgatgtgactctgagcctgctgcccttagtgaggagggccaggggccgtgtggtcaacgtctccagtgtcatgggccgggtgtcactttttggtggaggctactgcatctccaagtatggcgtggaagccttctctgactccctcaggagggaactctcctactttggggtgaaggtggctatgattgaacctggctatttcaagactgctgtgaccagtaaggagagattcttaaagagcttcctggagatttgggaccggtccagtccagaggtcaaggaggcctatggcgagaagtttgttgcagactataagaaatcagctgaacaaatggagcagaagtgcacacaggatctgtcgttggtgaccaactgcatggagcatgcgctgattgcctgccacccccgtactcgctactcagctggctgggatgccaagcttctctacctccccatgagctacatgcccaccttcctggtggatgccattatgtactgggtctctccaagcccggccaaggctctatgaagctaaggttggatgcatggttgcatggatttggggtgtgctatgaggggtggtgtatccttgggagagatataaagtggagggagggagccgtccggtcagtagggcaccaatcccacctccttcattacctcctggccatgattctcctgggagataattctgctctctggagatgttggtaggaaagtttcaagttacgcagctgagaaacagggaccaaatagtgctcctgggtgcattgtcaccgtgggtggccactcaagggtccaagcctctagggccatccttgggctaacaactggggtgggtgtgagcaggtggaaggagcctcagcccatgccattacctcctgcttccttatcaggctgtgtgttaattctgggccagtctacaccctcccacggggtggaaatggcctggaggatgtgagggcacccctcctctgaagatccctgtacacgtggtgttgggactggaaccattatgcggccccataggcctcaggagtcatcccagaagcagtggctgggaggtggtgtcctaagtaaggatctgtgcagaggacaaataaatcagtttttgatttgtctt

SEQ ID NO: 5591 - DNA, 2834 bp, Homo sapiens
atttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcgtggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgcttt

SEQ ID NO: 5592 - DNA, 3100 bp, Homo sapiens
tcaaagctgcctccgcctcctgactggagagcgaactagcccgggcggagccacagtcctagaggctgagcgcagtcggagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcgtggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaacatttgaaa

SEQ ID NO: 5593 - DNA, 1802 bp, Homo sapiens
acccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagaga

SEQ ID NO: 5594 - DNA, 1681 bp, Homo sapiens
aaaaggcggctgtgccggcctcctcctcagttggagggaggcagggaatctggcttgattggcgtgctgagacgcacctggcgcaaccctcccttctgaatcgaagttcaagtcccgcggacactgcaaccatgaaggagagacgggccccccagccagtcgtggccagatgtaagctcgttctggtcggggacgtgcagtgtgggaagaccgcgatgttgcaagtgttagcgaaggattgctatccagagacctatgtgcccaccgtgttcgaaaattacacagcctgtttggagacagaggaacagagggtggagcttagtctctgggatacctcaggatctccctactacgataatgtccgtccactctgctacagcgactcggatgcagtattactatgttttgacatcagccgtccagagacagtggacagcgcactcaagaagtggaggacagaaatcctagattattgtcccagcacccgcgttttgctcattggctgcaagacagacctgcgaacagacctgagtactctgatggagctgtcccaccagaagcaggcgcccatctcctatgagcagggttgtgcaatagcaaagcagctgggtgcagaaatctacctggaaggctcagctttcacctcagaaaagagcatccacagcatctttcggacggcatccatgctgtgtctgaacaagcctagcccactgccccagaagagccctgtccgaagcctctccaaacgactgctccacctccccagtcgctctgaactcatctcttctaccttcaagaaggaaaaggccaaaagctgttccattatgtgaagtggaaattggaggggggagacaaccccctacttcctcccttggggtgcagaggcacggggagagggaggatgagacaatttaggacactggacatgagtttttcagatggccacggtgagggcttggaaggagacaggaatggggcgaggaaggagccaggcccggcatgaggacctgacgctgagagagaaccatcataccccaagccaggcactagattttggagggggcgactaccccagtgccccccccgctccagaggaaggaaagctgtgggggacggggggcatgctggcctcatgggcttgggggcctacagcagcctcaccttcagcttcatgcctcttccacacagcgtttccatgcaggtcaggggatgggaggggtccctgagcccttcccttcccctctaaggaggcagcaacggagagtggggaagtggagcggcagctcccttgggggcttagcccaggtgcttcgtaactgcaatcggaagtgcaggagctggtcagagccaatgagaaggaaacctcatctttgcatagcccatgcctcatggagaggtgacatcatacattcacatgcttctcacctaagtccccagggtccaagggagaagccccagacccccttctcttgcagagtgtgggggtggtggtgctgcaggggcagggctgggtgggggtcaccagactttttctgcccttagggtagtacagctggcatttgttttatagactcttgtctttggaattggggggagggggggagtgtttcaatctgttatatgttctgtgtttaatgaagaaaacctatttattaatgaaaaatataatacatataaagaa

SEQ ID NO: 5595 - DNA, 552 bp, Homo sapiens
tggaggacagaaatcctagattattgtcccagcacccgcgttttgctcattggctgcaagacagacctgcgaacagacctgagtactctgatggagctgtcccaccagaagcaggcgcccatctcctatgagcagggttgtgcaatagcaaagcagctgggtgcagaaatctacctggaaggctcagctttcacctcagaaaagagcatccacagcatctttcggacggcatccatgctgtgtctgaacaagcctagcccactgccccagaagagccctgtccgaagcctctccaaacgactgctccacctccccagtcgctctgaactcatctcttctaccttcaagaaggaaaaggccaaaagctgttccattatgtgaagtgggggtcaccagactttttctgcccttagggtagtacagctggcatttgttttatagactcttgtctttggaattggggggagggggggagtgtttcaatctgttatatgttctgtgtttaatgaagaaaacctatttattaatgaaaaatataatacatataaagaa

SEQ ID NO: 5596 - DNA, 4151 bp, Homo sapiens
gagatgccggtgttggcggcccgagcggctgcagttgcaggggcgggggaggcggcggcggggcccgggagaggggtggcgtgggggaccggcgcgtagccgggaccatggaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactggacagtgttctcaagaagtggcaaggagagactcaagagttctgccccaatgccaaggttgtgctggttggctgtaaactggacatgcggactgacctggccacactgagggagctgtccaagcagaggcttatccctgttacacatgagcagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatgtgaggggctaggagagggcagagtgtgaagaggggtggtgagggacacaattgttcccctgcctgcgcccaggcttcctgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctcttttcctctcctctcacttctgcagctattctcacacatctaacctctaggcaacatgcactaaattcaaaagcaaggagaagcccttgccccccatcagtccaccagccctagaacctcccttgcctcaacagtcacctaataaagcccacctccatggaaaacggctgtggctttagttttgttgctttttaaaaaaatcaatctaccaatctttagcagtaagagggaaagttagacctcagctggggaactttcctgtccatgtccacagatagagcagaggacaaagccataggttggatcagaagtgtccttttaggagtcagagttgggagaaggagacatcctgggactgttcatcctagttaatgaagtgggcaattctcaggccattagggggttttagagcagaccgacatataattagtcagcatttctcagcccagccaggcctgctgctagtgtgggaggggtcctgctcaccatctgtacccctggcttggagcctgctggtaccctgggggttgtggggataaggaggcatcaggccgggcgcgctggctcacgcctgtaatcccagcactttgggaggccgaggtgggcggatcacaagttcaggagatcgagaccatcctggctaacacggtgaaaccccatctctactaaaaatacaaaaaattagccaggcgcggtggcagtgcctgtagtcccagctgctcgggaggctgaggcaggagaatggtgtgaacccgggtgaacctgggaggcggagcttgcagtgagccgagattgcgccactgcattctagcctggatgacagagcaagactctgtctccaaaaaaaaaaaaaaaaaaaaaaaagaaggcatcaaaagcctccacatcacagaagctacccctgtacagcgtgaagtttcctaagaggtcagtagtttgattctggggtctccttagaggctcaggccagggacctttctctcctcccatgctgagtttcatgatggctttcaggggagcatcagctgttagagtcacccctaccctgtcccttaaaggaaagacggtggagaggacggctgagcgcctgttgtcaggaaagacagtactggtctgttttctcgggagtctggtttcagattgtcctgtattcccttcctggctctggtcccactggcctcttttcggtgacattctcccccaggaaccatccctggcccttccctcccccagccctagccagttctcccagacacactggaagagaacactgaccttacccaactatctgctgggatcccacccaaatttatagcccattcctccctcattcattcattcagcaagtatgtactgaacaccaactgtgtggcatacactggcttgggagattgcaaggaccagtctctaagcttttggaggccagcccagtgtggaagagaggtacctcaggtgtgagggtgccatggctgagggatatttgtacatgtatgggatgctatgggagctccttgcagcctgagaagccagtcctgtgagccaggtcctgagggttgaagaggagttttccgggcagggaaggggtaggaaaggcactctgggcagagggtacagcatgtgtaaacacgtggagatgagaatgagcatagcactgttggggctcccatggcagggagaatagaagacaaggctaggaaggtacactgaggctactgcagggtccacagaggaatcagaatttcattctgaggatgaatgaaatcatcctcagaggatgaagccaccaggaatttcaggcagagagtgaagtgatcagagttgttttttggatagatggttatctggatgtggtgttggagctgggagatttggctctgaggtgtgtcatttaaaataatagcttctcggcagtggctcacacctataatcccagccaagattcctcctttgggaggccaagctgggaggatcgcttgaggccaggagttagagactgcagtgagctatgatcatgccattgtcttccagcctgagtgtcagagtgagaccctgtctctaaaaaaaattaaaaaataaaaaataaaaaatagcttctcctttcccttatgccaggttccagtcttgagaggaaaggaatccctacccaccactccctggatcatcagatatccctatcccaacctctcctatgggactagttcatctcagccagtctcaaagattctaggataacttcaatggcatttgaaattatctaagtgtgcttggataaccaccccctcaaactgagacctggttagggactgactcaaagaccctgagtcctcggctaagggtacaggagagggcaggggctccaggcccagctaggtggatctccatctgtctctgaggactgaccctttccccacaaggacctgccataaaaatcgacttgcgatttttagctgagtggcttctcttttccactttggacttctcagtgtatagcaggttcaagcctgcaaccaccaaagtgcagagtgtggagtgtttgtgccccctctttcctccaacctccatatcctgccatgtgagctcagggaatgcaaatgcatttaaatatccatctaaagcaaacataattagaaaaatcaatcagctggaggaccccccaaagtttaatacattttcaataccaccaggaatggatttttggtccctttctgcaggtctgggttgccagacgttttatttctggggaggagggctctgggctgaggagctcagtgggtgggaggagggaatgggactgttgctgatcctcaaaggcctctgtaggatggagggaggggaccttactcccttccccaccccagatgcaggagtcacccagcttccttctctgcgctgtttccttcacaaattagacattggtttgggaaacaatgtagcctcgttaaacatttaatgaaataaacaaataatcacactgtg

SEQ ID NO: 5597 - DNA, 4154 bp, Homo sapiens
gagatgccggtgttggcggcccgagcggctgcagttgcaggggcgggggaggcggcggcggggcccgggagaggggtggcgtgggggaccggcgcgtagccgggaccatggaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactggacagtgttctcaagaagtggcaaggagagactcaagagttctgccccaatgccaaggttgtgctggttggctgtaaactggacatgcggactgacctggccacactgagggagctgtccaagcagaggcttatccctgttacacatgagcaggtgggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatgtgaggggctaggagagggcagagtgtgaagaggggtggtgagggacacaattgttcccctgcctgcgcccaggcttcctgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctcttttcctctcctctcacttctgcagctattctcacacatctaacctctaggcaacatgcactaaattcaaaagcaaggagaagcccttgccccccatcagtccaccagccctagaacctcccttgcctcaacagtcacctaataaagcccacctccatggaaaacggctgtggctttagttttgttgctttttaaaaaaatcaatctaccaatctttagcagtaagagggaaagttagacctcagctggggaactttcctgtccatgtccacagatagagcagaggacaaagccataggttggatcagaagtgtccttttaggagtcagagttgggagaaggagacatcctgggactgttcatcctagttaatgaagtgggcaattctcaggccattagggggttttagagcagaccgacatataattagtcagcatttctcagcccagccaggcctgctgctagtgtgggaggggtcctgctcaccatctgtacccctggcttggagcctgctggtaccctgggggttgtggggataaggaggcatcaggccgggcgcgctggctcacgcctgtaatcccagcactttgggaggccgaggtgggcggatcacaagttcaggagatcgagaccatcctggctaacacggtgaaaccccatctctactaaaaatacaaaaaattagccaggcgcggtggcagtgcctgtagtcccagctgctcgggaggctgaggcaggagaatggtgtgaacccgggtgaacctgggaggcggagcttgcagtgagccgagattgcgccactgcattctagcctggatgacagagcaagactctgtctccaaaaaaaaaaaaaaaaaaaaaaaagaaggcatcaaaagcctccacatcacagaagctacccctgtacagcgtgaagtttcctaagaggtcagtagtttgattctggggtctccttagaggctcaggccagggacctttctctcctcccatgctgagtttcatgatggctttcaggggagcatcagctgttagagtcacccctaccctgtcccttaaaggaaagacggtggagaggacggctgagcgcctgttgtcaggaaagacagtactggtctgttttctcgggagtctggtttcagattgtcctgtattcccttcctggctctggtcccactggcctcttttcggtgacattctcccccaggaaccatccctggcccttccctcccccagccctagccagttctcccagacacactggaagagaacactgaccttacccaactatctgctgggatcccacccaaatttatagcccattcctccctcattcattcattcagcaagtatgtactgaacaccaactgtgtggcatacactggcttgggagattgcaaggaccagtctctaagcttttggaggccagcccagtgtggaagagaggtacctcaggtgtgagggtgccatggctgagggatatttgtacatgtatgggatgctatgggagctccttgcagcctgagaagccagtcctgtgagccaggtcctgagggttgaagaggagttttccgggcagggaaggggtaggaaaggcactctgggcagagggtacagcatgtgtaaacacgtggagatgagaatgagcatagcactgttggggctcccatggcagggagaatagaagacaaggctaggaaggtacactgaggctactgcagggtccacagaggaatcagaatttcattctgaggatgaatgaaatcatcctcagaggatgaagccaccaggaatttcaggcagagagtgaagtgatcagagttgttttttggatagatggttatctggatgtggtgttggagctgggagatttggctctgaggtgtgtcatttaaaataatagcttctcggcagtggctcacacctataatcccagccaagattcctcctttgggaggccaagctgggaggatcgcttgaggccaggagttagagactgcagtgagctatgatcatgccattgtcttccagcctgagtgtcagagtgagaccctgtctctaaaaaaaattaaaaaataaaaaataaaaaatagcttctcctttcccttatgccaggttccagtcttgagaggaaaggaatccctacccaccactccctggatcatcagatatccctatcccaacctctcctatgggactagttcatctcagccagtctcaaagattctaggataacttcaatggcatttgaaattatctaagtgtgcttggataaccaccccctcaaactgagacctggttagggactgactcaaagaccctgagtcctcggctaagggtacaggagagggcaggggctccaggcccagctaggtggatctccatctgtctctgaggactgaccctttccccacaaggacctgccataaaaatcgacttgcgatttttagctgagtggcttctcttttccactttggacttctcagtgtatagcaggttcaagcctgcaaccaccaaagtgcagagtgtggagtgtttgtgccccctctttcctccaacctccatatcctgccatgtgagctcagggaatgcaaatgcatttaaatatccatctaaagcaaacataattagaaaaatcaatcagctggaggaccccccaaagtttaatacattttcaataccaccaggaatggatttttggtccctttctgcaggtctgggttgccagacgttttatttctggggaggagggctctgggctgaggagctcagtgggtgggaggagggaatgggactgttgctgatcctcaaaggcctctgtaggatggagggaggggaccttactcccttccccaccccagatgcaggagtcacccagcttccttctctgcgctgtttccttcacaaattagacattggtttgggaaacaatgtagcctcgttaaacatttaatgaaataaacaaataatcacactgtg

SEQ ID NO: 5598 - DNA, 1254 bp, Homo sapiens
gagatgccggtgttggcggcccgagcggctgcagttgcaggggcgggggaggcggcggcggggcccgggagaggggtggcgtgggggaccggcgcgtagccgggaccatggaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactggacagtgttctcaagaagtggcaaggagagactcaagagttctgccccaatgccaaggttgtgctggttggctgtaaactggacatgcggactgacctggccacactgagggagctgtccaagcagaggcttatccctgttacacatgagcagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatgtgaggggctaggagagggcagagtgtgaagaggggtggtgagggacacaattgttcccctgcctgcgcccaggcttcctgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctcttttcctctcctctcacttctgcagctattctcacacatctaacctctaggcaacatgcactaaattcaaaagcaagga

SEQ ID NO: 5599 - DNA, 10077 bp, Homo sapiens
atggagactgaaagtgagagtagcactttaggggatgacagtgtcttctggttggagtctgaagttataatccaggtgactgactgtgaagaggaagaaagggaagagaagttcaggaagatgaagtcctcagtacattctgaagaagatgattttgttccagagctacatagaaatgtacaccctcgagagcggcctgattgggaagaaactcttagcgcaatggcaagaggcgcagatgttccagagattcctggagatcttactcttaagacgtgtggcagtacagccagtatgaaggttaagcatgtgaaaaagttacccttcactaaaggtcactttccgaagatggctgaatgtgcgcatttccattatgagaatgttgagttcggcagcatacagctttcactttcagaagaacagaatgaagtaatgaaaaatggctgtgaatctaaagagctggtctacctcgtgcagattgcttgtcagggaaaaagttggattgttaaaagaagttatgaagattttcgggtacttgataaacatcttcatctgtgtatttatgaccgaagattttcccagctctcagaacttccccgttctgacaccctgaaggacagtccagagtcggtcactcagatgcttatggcttacctgtcacgcctttcagctatcgctggcaacaagatcaactgtgggcccgcccttacctggatggagattgataataagggaaatcaccttttggttcatgaggagtcatccatcaacactcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaagcccagcatggtttgactggatagacacgcataatttattatgaatataaatttccatgtttgtttctgttcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttgtaattaccatctacaccagcatttcaggtatagctctttataactctggagacatgtaaaacatgtttaacacccacgagttttgaaagttgcattccttattagagtaggaactctctagcccaactccattctatgttctcagctccctccaccccccaaaatacatcagactagcaaggcagtcctatgtttacaaaacgagtttagattgtcatttcattccataactcttaataatactcaagttttatacattcacgtattttaaatgctcggtctgtagaagacactaggagaattgcattccaattactggatggttgctgctctggctttttagaacttgaaattaatttttatttagagcaaaggaggaaatcttttaagaggctaaaatcatgctgctattattgctgtgaaattgtataaagattaggattcatgccagtttttattttaaaaaataatgtgcattttaagggtttatatttagaaaaaaataaaatgtttcaagaacaacacattgatatgtggaaatattctataaggttttcttttgttcccttagaattcattggagggatgcagtaaaaactgtagtagaaaccttgaaacacccatatgtgaaaaggtctgtggaaattgaggcctctacattaaaagtgcagaaccaactgttttacagtcaaagtgctaggaaacctgataggatacttccctttggcacaaaaacaccctgggtgctacatacaggagtatgacctttggtgaatatgtggcactaattttttttaccttaatcatattcttgtcaagtaggcaacccattgccccttggagaccacaccagccctgtaagttctcaccagcagcatggagattaggaagaggggctgctgtgaccaggagatacacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtccctgggatggtcccacgactagggcctgcacatttcttacaatggcaaagcattttttaaaatttagggtcaggttgaaaaattctaggactaattctgtagagaggagggactgttaactaacgtgagtggggacggaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtggggggtggcaggggagggaggaagggatttttgtacctggagatggagatatcttgtggtttaaagcaaatgtcccactgaaagtgattc

SEQ ID NO: 5600 - DNA, 1839 bp, Homo sapiens
atggagactgaaagtgagagtagcactttaggggatgacagtgtcttctggttggagtctgaagttataatccaggtgactgactgtgaagaggaagaaagggaagagaagttcaggaagatgaagtcctcagtacattctgaagaagatgattttgttccagagctacatagaaatgtacaccctcgagagcggcctgattgggaagaaactcttagcgcaatggcaagaggcgcagatgttccagagattcctggagatcttactcttaagacgtgtggcagtacagccagtatgaaggttaagcatgtgaaaaagttacccttcactaaaggtcactttccgaagatggctgaatgtgcgcatttccattatgagaatgttgagttcggcagcatacagctttcactttcagaagaacagaatgaagtaatgaaaaatggctgtgaatctaaagagctggtctacctcgtgcagattgcttgtcagggaaaaagttggattgttaaaagaagttatgaagattttcgggtacttgataaacatcttcatctgtgtatttatgaccgaagattttcccagctctcagaacttccccgttctgacaccctgaaggacagtccagagtcggtcactcagatgcttatggcttacctgtcacgcctttcagctatcgctggcaacaagatcaactgtgggcccgcccttacctggatggagattgataataagggaaatcaccttttggttcatgaggagtcatccatcaacactcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgctgccacacttcagcgcacgcacagaactaatcgtccccttccccctccgccttcccagaaaacagtttactcctcctttgctaggcccgatgtcaccactgaaccctttggtccagataactgtttgcatttcaatatga

SEQ ID NO: 5601 - DNA, 8193 bp, Homo sapiens
gattatgaagagacctctaagaaggaggcaagaggcgcagatgttccagagattcctggagatcttactcttaagacgtgtggcagtacagccagtatgaaggttaagcatgtgaaaaagttacccttcactaaaggtcactttccgaagatggctgaatgtgcgcatttccattatgagaatgttgagttcggcagcatacagctttcactttcagaagaacagaatgaagtaatgaaaaatggctgtgaatctaaagagctggtctacctcgtgcagattgcttgtcagggaaaaagttggattgttaaaagaagttatgaagattttcgggtacttgataaacatcttcatctgtgtatttatgaccgaagattttcccagctctcagaacttccccgttctgacaccctgaaggacagtccagagtcggtcactcagatgcttatggcttacctgtcacgcctttcagctatcgctggcaacaagatcaactgtgggcccgcccttacctggatggagattgataataagggaaatcaccttttggttcatgaggagtcatccatcaacactcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggtaccgtttgttttcctccattctttctttaagttaagagggatcttcaatcctgtgtgccatctgtgccttttaagagagaaatttgtccacagctagcctttaatcaaagagaatgcttttctgggtggtgctgatggctcagagccctaaattaaaagcagtccaacaaaactccccaaaagggccaatggtcctgcttcaaatcttcacaaaagtccccttatctctttggacggtgagaattcgtggataatttttgcacaactgcgtagctcttgattctgtttttctcttctaataaaatatctttattgtagccttccaagttaacaagccagctacaccatcaaatgtaaaaactgttcataataacagtctacaagcacttgaagcttgttttctaagcaatcttttctgagccaggtgagggacatgctttttttcccccccatctctgtaacaattcaagaagagattgcagtctttatacactgtttgttttagttttccttctgaaccagatgtgttttcaacagcatttgcatgtgggatagaagatcatggattgccattttgaaatatggaaggcacctattttttaatgatcacatggggagtgtttggctttccatttaggataacgtaagctaccttttcactctcattttttttcccaatttcccactaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggtaagaaggggaagatatcagtgagatgaaatatactattaccaaaggtatgtcacttttcagcagggtgtgttgttatctttgagtcagacacaacaattacttttaagccctgtggctggtttccatgagatagttcccatttgaggttggagtctgccattaccttgatgctggcttttccccaggaaaggagtagctcctagatgactatagcttaactgtacctgctcccttttcttcctaaagtgtctcggtagtttattccagtaacacaaagagatcaggatcaaatgagacaaagtgggctttacggttgtgggttgctttttcttatttttttccaactccatcactgactcattgtgactttgggcaagtcatttacctaccctctgccaattattcacagttacacaatgaaaatacttcattctcaaaacattcgtaagactgtctgccttgcagactttttggaagtataagagattatagtgccttgggattttttgttactttcctagcattcaccagcagtttgtcccatagtcaggtgcctgtttcaatgagagaatgtagtatgcagaatgctaaggtttcttcctgaatttcctcatattttaagaaagtgccacaggttgtttttcttctatatggtcaccttgaactattaataggacttaagattttagaccttagtggaggatgctgtgtttactgcttctcaaggatagcatgttttcagtatgaggattatctttggccagactaaggtggaatcaaaggtaggagagaggcagtagcttctgatttgaatattgcctttccctatgtttgaagccctaaaactgctaactgtgtacaactgtgaatttcaaaagtctccccagatgatagaattaactcttaatttaacaagatgtcctttgtgttgagactgagctagactaatagaccgggtatgtatttttaagctctacagcattacttgactaaacctctcttttggtttgtatattaaaattatgccataggcaacctcatctcgcatttaaaacctctcataaattagaaaactttgaatggttctccaaagataatactgggtgttgtacaaaatagcagcacaagccttcttttcctagaaatgggtacagattcattgcaaccacatggcttgggaaagttcaagctgctacccaaccagccttaatttgtgagttacaaatttaatagtacttgattcatagagggaacaaaaaatagacccatagtattatcatctttcaataggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagc

SEQ ID NO: 5602 - DNA, 5289 bp, Homo sapiens
gcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctgga

SEQ ID NO: 5603 - DNA, 3235 bp, Homo sapiens
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccg

SEQ ID NO: 5604 - DNA, 3095 bp, Homo sapiens
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaaggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctg

SEQ ID NO: 5605 - DNA, 3372 bp, Homo sapiens
ggcccgctcacggccgcgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagctctggcccccgcagaggcctgtggccgcttccagctgtgcacctgtgtgctggctccaagctgggtttctcgtgcaccctccatggtggggtgccatgtgcgcaccttccactcatcagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccga

SEQ ID NO: 5606 - DNA, 2721 bp, Homo sapiens
ctcacggccgcgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagcca

SEQ ID NO: 5607 - DNA, 2987 bp, Homo sapiens
attcagaggctttccaggaacgagggagagacaggaagccaaactgaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgct

SEQ ID NO: 5608 - DNA, 3560 bp, Homo sapiens
gaatatagtgactccactttcctcttaagacctcttaaaagaggttcgcctcaggcagagttaaaggtgggagctgacccgttccaaagcagaggcaacgtgaactggccactaggggcagggagctgggaccttgtgttccctgttgagggacgatgatgtctaccaccttcttgacagaagcatggtgtctcaggcctctggacacactacaactcagagtctgttagccccagatttcatcttcctgttaggatcccttcctaatagctccagaggaagatgactgtccatccatcaggctaggctggggagagaggaggagtttgtagagcagcaaaaatagtctgtcattgagaagcttccactgccatccagctgctttggccatgttcaggaggagaacctgtggcacggaggcatctttgagatggagccacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagctgaggtggcaggcagcaaggttgtccctgcactaccagagagtggccagtcagagcctgggccacctgaagtggaaggcggaacaaaggctacggggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaagg

SEQ ID NO: 5609 - DNA, 5788 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacaggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagctgaggtggcaggcagcaaggttgtccctgcactaccagagagtggccagtcagagcctgggccacctgaagtggaaggcggaacaaaggctacggggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgt

SEQ ID NO: 5610 - DNA, 6889 bp, Homo sapiens
agcgaaatctccgtttcatggaggctgaggcaagagaaaatttcggagcctggatgtggaggagcccaacagcagaactaactcaggaaattgtctttcagaaaaaggccgaacgtaggctgggtctgagaatcaggctggggtaggtggaggaacctgcaagtttaaaggaaaaagaaaaggagagaatattttcagagattatctctggtttgttatcattactaccatcttaaaggtaaaaagcattgcatttcaggtgttctttgatttttattttatttttttttttggtgcaattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagctgaggtggcaggcagcaaggttgtccctgcactaccagagagtggccagtcagagcctgggccacctgaagtggaaggcggaacaaaggctacggggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttca

SEQ ID NO: 5611 - DNA, 2552 bp, Homo sapiens
attcagctctccgctccgctgggacccgcacagcgccagtggctcgggggtcggccctcgcctcctccccggcccgggcctagagccacccctaaccagaggccggagacagctggagcggctgccgcatcccggcccagcctcccctaccatccctcccccttccactggacatctggaccctaggcccccgcaccgacagggttccggaaaccctccccgcccagcccggcggccgggccccgcgcctctctctctctagagcccccagccctcctcaagactagacttccgcctacccctggacacctcctcccggtcccctccctccccccctcccacagcctggaccggggtaggagggagggggggtgtgcgcccggcgccgtccccgccccgccccccgtgattccccctgcatggccggcccgggtggggggcgcgggggggcccgggcgccatgcggggggggcacaaagggggtcgctgtgcctgtccccgtgtgatccgaaaagtgctggcaaaatgcggctgctgcttcgcccgggggggacgtgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcagcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatca

SEQ ID NO: 5612 - DNA, 1142 bp, Homo sapiens
ctcgaccctgaaacttggagcagggtgggggttcagtatgaagcccccggaccgccccgcccctggccgcactgaccggatactgggggtcatggggggcatgctgcgcgcatgcgccctccctgggcaggaggggcccccaaggagaagccctctagggttggtgggtaccgagccagagtctgaacgtacggagggagatcacagaagggatcgcgaacatgaggtcctcgccggggctctgcagcccgccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcatgcgccaggtgttctgccagatgcaggaacttccacaactatggcacatcagccgagtggactttgtgagaaatgccattacccccagattgccccctctcatcttgttagcatccccagcctctgccctgaaccaaacctaa

SEQ ID NO: 5613 - DNA, 2246 bp, Homo sapiens
ctcgaccctgaaacttggagcagggtgggggttcagtatgaagcccccggaccgccccgcccctggccgcactgaccggatactgggggtcatggggggcatgctgcgcgcatgcgccctccctgggcaggaggggcccccaaggagaagccctctagggttggtgggtaccgagccagagtctgaacgtacggagggagatcacagaagggatcgcgaacatgaggtcctcgccggggctctgcagcccgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcagcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatca

SEQ ID NO: 5614 - DNA, 6219 bp, Homo sapiens
aaaccttggcttcagcccggccgccgccaggcgttggcatcgccggggagagccttccggactccgggcggcggctggctgggggcgcgttccgaggcgccctcaggcagggcgcgggggcagagcctcgcctgggttctggaggctgcggggccatcgctccagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggctccagtatgacaaagtgcagttgtacgttgacatctcccccgggactgtggactggaaccacatctactttgaaagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatt

SEQ ID NO: 5615 - DNA, 5246 bp, Homo sapiens
aaaccttggcttcagcccggccgccgccaggcgttggcatcgccggggagagccttccggactccgggcggcggctggctgggggcgcgttccgaggcgccctcaggcagggcgcgggggcagagcctcgcctgggttctggaggctgcggggccatcgctccagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggtaattaacactttaaacatcatctgtatagtttgaacaagaagttgtccctctgaatggttggctcttgtgtagagtgaatcaaagtcctccctagcatgggaataaatcggtactgatga

SEQ ID NO: 5616 - DNA, 6118 bp, Homo sapiens
tcattgcagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatgatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatta

SEQ ID NO: 5617 - DNA, 560 bp, Homo sapiens
atcgccggggagagccttccggactccgggcggcggctggctgggggcgcgttccgaggcgccctcaggcagggcgcgggggcagagcctcgcctgggttctggaggctgcggggccatcgctccaggcccacagcgtccccgcattggttggctgggtgggccgaggaacagtggcaacatctgtgtttgtgcggcttctcccgccttgacccctgcctgggtatccacacatctcctcacaccaggagttatagaggttcaccacggaccacaccaattgggcaaaatccaaagaaaatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgacca

SEQ ID NO: 5618 - DNA, 6273 bp, Homo sapiens
aaaccttggcttcagcccggccgccgccaggcgttggcatcgccggggagagccttccggactccgggcggcggctggctgggggcgcgttccgaggcgccctcaggcagggcgcgggggcagagcctcgcctgggttctggaggctgcggggccatcgctccagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatgatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatt

SEQ ID NO: 5619 - DNA, 6351 bp, Homo sapiens
aaaccttggcttcagcccggccgccgccaggcgttggcatcgccggggagagccttccggactccgggcggcggctggctgggggcgcgttccgaggcgccctcaggcagggcgcgggggcagagcctcgcctgggttctggaggctgcggggccatcgctccagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggctccagtatgacaaagtgcagttgtacgttgacatctcccccgggactgtggactggaaccacatctactttgaaagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatt

SEQ ID NO: 5620 - DNA, 4883 bp, Homo sapiens
acaactaagcatgcgccgcggccgagccgtccgctttaaggccctcccctcccgcacccggccccaggaacccggggcgccccggatcgggaacgtgcgtgatgacgcacgtgcgcgcgaagacgtggggacgcaggcgggtcgtagagagcgttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggagttttgtttgctttgaaagttcttaacaaccattattgccctggaggctttgtcaacattttgggctttcctgtaccgaacagatttgcttgttgggtcgaacttgtggctattcatttattctcaccagggacttccttcgctgggcatctggctgggattcttgttggactaatgtacactcaagggcctctgaagaaaatcatggaagcatgtgcaggcggtttttcctccagtgttggttacccaggacggcaatactactttaatagttcaggcagctctggatatcaggattattatccgcatggcaggccagatcactatgaagaagcacccaggaactatgacacgtacacagcaggactgagtgaagaagaacagctcgagagagcattacaagccagcctctgggaccgaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggcccctatgagtcaactcacagcttgcggggagtgggccttctcctggccttgttcttgctcataaacaggtcacttcctccatgaagagaccagtttccacgctcccatctctcactgctgactcagcgatgcctctgcctcggtctgcttttgaagactgtgaccttcaccaggaggttttacttacaccagtcgggaagattagtccctcattctgcctggagtgccccgtgtttgacttggcagcgggtgtggagccatccccgcgtcctcctggcgcattgccactgtggctgtccaggaacaggatgtggctgccttggccgaatgttgtcctactctccccaaccccggcgcctcagctcctcagctcctcgggcccctgcgtctggctggtgtttgcagggctttcgctctgctctggtattgctctgcctttatagaaagtcttattgaagaagtgtaagaaagacctaaggtggggaagactcctacacacaccattagtatcagtgacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgcctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattgagaaaattcacaatataaacagaaatacaaataaatacatacacaattttaaagtcacctgtagccctacccttagaggtacccagggttaacattttggtggtattgtcttatcaatttttccgttgatacattcagcaaatttggagcacattgaccatggagttttgtgtccaaatccaatctgaatttacctggaagaggccttgacacctgcatggaaatgagctaagaaaaccactggagccttgggagctctttggcctcctggctggcccagtaatatctgagctcctttggttaatttataactgatataaaactacatcttctttataatataaattgtacctgtgagtctagaagctttaaatgtgtttaaattaaaatattcaagctaaatgttactgctctctcccaaattctgtaagtttgactcccgttaccccaattagaagtaacttctttgtttcatgccacttttatagcatttggtaattctgctataacacatcttgcccctattattaactgtgcacagctacacaaaggtgtgccttctacgtgggaacatggattgtgaatgactctgtaatgaggcctgagtcttagttatctttccactcactccccgtctcccctttccaaccccaaaggctcacgataggggctcactaaatgtcagtgtttcaccaaagtattttttccattgtattaagagtccagtcactgtatatggaagtattttattttttatttttttatatcacttgagtccactagtagtacttccttgctctgtttgacttgtcagatacaaagacacgggattagattttgggtggtaaaattgtgatacgcatggctgttgatggagtggaacatcttagtgatgtgagaaaggtcattttagttataaatgtaaaccaattactttagcacaacaataaagatgttctggaaattattataattattttagttaatggacttgcctgtaacaagtgcttatgtttggaatgtccattttattttattttcctctacaataaggaatccctaaagttatgccaacaaactggaattggattgagaaagacaaaagcaagtgagcaagtgtattagactaattatctctagtagggaataagcacttagagctaattttttaatttggtttatttattagtagctccctgattgtctgttaagcccctggttcccacagtttggtgtggtcagtcaacttaagcgaccttttaatgcagaatctttacttggttctgaagaggaggcagtagttaaaattgcttcctcttaatgactctgaatgtattgcctgtgattccaaagttgtacataattgttcagacctcctccatccttttaaattgcctgctgcagtaaataactagtttgagtagaactagatcctgtctatctatttggcacatgttctgctgcctggggagtaagcaagctaaagggatgagaaagaccacctccccctaccctggaaattgcactgcaaggcagggcgagaatggggtagctggcagacctggcctccttgttcccagtcttagtttttcttgagagattcagtattcagtaaagaatagcattcaattagtcaaaaaatatatatataacttcttcctttcccttcccatgaatcattgcagtcattccctaagtttcttctctttttttttcatggctgctagtattttattttagaatcacagactctcagcttagagagtcacagtatctcaattatttgctctgttcaatacttaacaatacctcctcactcaattctacataactccagcttagtcttccaaaattcactttcatgatgccactcagcatctcaaatacctttcattggctctctgctgccaaaggataaaggtcaaagtcattagcctcaacagtgggcttcaaccagcctttggacctcagccccatttatccatcacagaggctggtaactagtctcactgctcaggctgtgagtgttcctgatcttgtgacattctgtgctgtgcttttacatggaacagctctttcctctctcttggcccattcagatcctcctcatccagcccccatctgaatcctgtaacagacacaaccacatctacacagtttccacataccacttggaattgctggttatgctgcaatgagagaatgtctttgtctttaaattgtaagcttcatgagggcagggaccatctgtttctctgtctctcctcacagtgccttgagcagtacgttgtctggaatgtcagaaccaataaatacttgtggattgaaacaaaaagagaa

SEQ ID NO: 5621 - DNA, 5151 bp, Homo sapiens
ggccgagccgtccgctttaaggccctcccctcccgcacccggccccaggaacccggggcgccccggatcgggaacgtgcgtgatgacgcacgtgcgcgcgaagacgtggggacgcaggcgggtcgtagagagcgggtccattgtagggggagaaagaaatattcaggatttaaagcagctgctctaaaggctacattcactgcaatgttgagaagggagcctcttaaacagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggagttttgtttgctttgaaagttcttaacaaccattattgccctggaggctttgtcaacattttgggctttcctgtaccgaacagatttgcttgttgggtcgaacttgtggctattcatttattctcaccagggacttccttcgctgggcatctggctgggattcttgttggactaatgtacactcaagggcctctgaagaaaatcatggaagcatgtgcaggcggtttttcctccagtgttggttacccaggacggcaatactactttaatagttcaggcagctctggatatcaggattattatccgcatggcaggccagatcactatgaagaagcacccaggaactatgacacgtacacagcaggactgagtgaagaagaacagctcgagagagcattacaagccagcctctgggaccgaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggcccctatgagtcaactcacagcttgcggggagtgggccttctcctggccttgttcttgctcataaacaggtcacttcctccatgaagagaccagtttccacgctcccatctctcactgctgactcagcgatgcctctgcctcggtctgcttttgaagactgtgaccttcaccaggaggttttacttacaccagtcgggaagattagtccctcattctgcctggagtgccccgtgtttgacttggcagcgggtgtggagccatccccgcgtcctcctggcgcattgccactgtggctgtccaggaacaggatgtggctgccttggccgaatgttgtcctactctccccaaccccggcgcctcagctcctcagctcctcgggcccctgcgtctggctggtgtttgcagggctttcgctctgctctggtattgctctgcctttatagaaagtcttattgaagaagtgtaagaaagacctaaggtggggaagactcctacacacaccattagtatcagtgacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgcctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattgagaaaattcacaatataaacagaaatacaaataaatacatacacaattttaaagtcacctgtagccctacccttagaggtacccagggttaacattttggtggtattgtcttatcaatttttccgttgatacattcagcaaatttggagcacattgaccatggagttttgtgtccaaatccaatctgaatttacctggaagaggccttgacacctgcatggaaatgagctaagaaaaccactggagccttgggagctctttggcctcctggctggcccagtaatatctgagctcctttggttaatttataactgatataaaactacatcttctttataatataaattgtacctgtgagtctagaagctttaaatgtgtttaaattaaaatattcaagctaaatgttactgctctctcccaaattctgtaagtttgactcccgttaccccaattagaagtaacttctttgtttcatgccacttttatagcatttggtaattctgctataacacatcttgcccctattattaactgtgcacagctacacaaaggtgtgccttctacgtgggaacatggattgtgaatgactctgtaatgaggcctgagtcttagttatctttccactcactccccgtctcccctttccaaccccaaaggctcacgataggggctcactaaatgtcagtgtttcaccaaagtattttttccattgtattaagagtccagtcactgtatatggaagtattttattttttatttttttatatcacttgagtccactagtagtacttccttgctctgtttgacttgtcagatacaaagacacgggattagattttgggtggtaaaattgtgatacgcatggctgttgatggagtggaacatcttagtgatgtgagaaaggtcattttagttataaatgtaaaccaattactttagcacaacaataaagatgttctggaaattattataattattttagttaatggacttgcctgtaacaagtgcttatgtttggaatgtccattttattttattttcctctacaataaggaatccctaaagttatgccaacaaactggaattggattgagaaagacaaaagcaagtgagcaagtgtattagactaattatctctagtagggaataagcacttagagctaattttttaatttggtttatttattagtagctccctgattgtctgttaagcccctggttcccacagtttggtgtggtcagtcaacttaagcgaccttttaatgcagaatctttacttggttctgaagaggaggcagtagttaaaattgcttcctcttaatgactctgaatgtattgcctgtgattccaaagttgtacataattgttcagacctcctccatccttttaaattgcctgctgcagtaaataactagtttgagtagaactagatcctgtctatctatttggcacatgttctgctgcctggggagtaagcaagctaaagggatgagaaagaccacctccccctaccctggaaattgcactgcaaggcagggcgagaatggggtagctggcagacctggcctccttgttcccagtcttagtttttcttgagagattcagtattcagtaaagaatagcattcaattagtcaaaaaatatatatataacttcttcctttcccttcccatgaatcattgcagtcattccctaagtttcttctctttttttttcatggctgctagtattttattttagaatcacagactctcagcttagagagtcacagtatctcaattatttgctctgttcaatacttaacaatacctcctcactcaattctacataactccagcttagtcttccaaaattcactttcatgatgccactcagcatctcaaatacctttcattggctctctgctgccaaaggataaaggtcaaagtcattagcctcaacagtgggcttcaaccagcctttggacctcagccccatttatccatcacagaggctggtaactagtctcactgctcaggctgtgagtgttcctgatcttgtgacattctgtgctgtgcttttacatggaacagctctttcctctctcttggcccattcagatcctcctcatccagcccccatctgaatcctgtaacagacacaaccacatctacacagtttccacataccacttggaattgctggttatgctgcaatgagagaatgtctttgtctttaaattgtaagcttcatgagggcagggaccatctgtttctctgtctctcctcacagtgccttgagcagtacgttgtctggaatgtcagaaccaataaatacttgtggattg

SEQ ID NO: 5622 - DNA, 556 bp, Homo sapiens
gcgcgaagacgtggggacgcaggcgggtcgtagagagcatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggagttttgtttgctttgaaag

SEQ ID NO: 5623 - DNA, 577 bp, Homo sapiens
agcagctccccagcctccggctgcgctggggcccggaaggacgaagcttcccggcagagaacctgggcagaggcgtccgttgggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgactt

SEQ ID NO: 5624 - DNA, 777 bp, Homo sapiens
ctttgtttggagacagtctctttctgccacccaggctggagtgcaatggtgcaatcttggatcactgtaaccgctgcctccagggttcaaacgattctcctgcctcagcttcccaggtagctgggattacaggcgtctgccaccacgcccagctaatttttgtatttttagtagagacggtttcaccacgtttgccaagctggtcccgaactcctgacctcaggggtccattgtagggggagaaagaaatattcaggatttaaagcagctgctctaaaggctacattcactgcaatgttgagaagggagcctcttaaacagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgcctta

SEQ ID NO: 5625 - DNA, 596 bp, Homo sapiens
gtgatgacgcacgtgcgcgcgaagacgtggggacgcaggcgggtcgtagagagcgggtccattgtagggggagaaagaaatattcaggatttaaagcagctgctctaaaggctacattcactgcaatgttgagaagggagcctcttaaacagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtata

SEQ ID NO: 5626 - DNA, 371 bp, Homo sapiens
acgtgcgcgcgaagacgtggggacgcaggcgggtcgtagagagcggagcctcttaaacagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggttcagccgtctgtatatctccccagatacctgaaactgaccacctgagtacgttttcccattgctgagctgtttccctgatatctggccatgcaacggagatcaaga

SEQ ID NO: 5627 - DNA, 576 bp, Homo sapiens
agacgtggggacgcaggcgggtcgtagagagcgggtccattgtagggggagaaagaaatattcaggatttaaagcagctgctctaaaggctacattcactgcaatgttgagaaggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaattt

SEQ ID NO: 5628 - DNA, 1802 bp, Homo sapiens
atggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcactgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctga

SEQ ID NO: 5629 - DNA, 1878 bp, Homo sapiens
gccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagccactatggaaggaggggtcaggattacagcagaggagactggcacacagagtgttaagtgacacccactcaatccaccccgaagctgttacacttaattaaccctcaaactgcccagtgagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcactgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctgacctgc

SEQ ID NO: 5630 - DNA, 1797 bp, Homo sapiens
atggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatcctcacctactgctattccatcgacctctcagagcgagtggcactgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggcctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggccaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctg

SEQ ID NO: 5631 - DNA, 1274 bp, Homo sapiens
gccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcactgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctga

SEQ ID NO: 5632 - DNA, 1794 bp, Homo sapiens
gggagacggagatcggcgggagggctgggggaagggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggca

SEQ ID NO: 5633 - DNA, 755 bp, Homo sapiens
ggcccgggccagcggggaagggtccccaaggccggtcggctgggtgggaggcctcgaacgccgtgcctggccccgagaccctatccccggtaacggtcgaggtggagcaggccctttaatcatccctcatccgatatccttgtttctacagaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctag

SEQ ID NO: 5634 - DNA, 900 bp, Homo sapiens
tcaggagggatgaaccaccgcttactcgttcttcgcgtccgcaactcttgtcccagtcctctctaaagagcgcccgacgtgacactcgggccaaaatagcatctaaggggccagagcggggaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtg

SEQ ID NO: 5635 - DNA, 1560 bp, Homo sapiens
cttggaccttggccctcgctttccaggatgggtagggtggaagacgggggaacaactgaggagctggaggactgggacccaggcaccagtgccctgccagctcctgggatcaagcagggtcccagggaacagacaggcacggggcccctgtcccaaaagtgctgggagcctgagcctgatgctcccagccagcctggcccagccctttggtccaggggtcgggcccgcactcaggccttggctggcggctcctcactgcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctgatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccagatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggctggagcagctggggttcaacgccctcctgcagctgatgatcggggtgcccctggagatggtgcacggcctgctccgcatcagcctgctctacctggcaggcgtgctggcaggctccctaaccgtctccatcaccgacatgcgggccccggtggtgggaggctccggcggggtctacgccctgtgctcggcacacctggccaacgttgtcatgaactgggctgggatgagatgtccctacaagttgctgaggatggtgctggccttggtgtgcatgagctccgaggtgggccgggccgtgtggctgcgcttctccccgccgctgcccgcctcgggcccacagcccagcttcatggcgcacctggcaggcgcggtggtgggggtgagcatgggcctgaccatcctgcggagctacgaggagcgcctgcgggaccagtgcggctggtgggtggtgctgctggcctacggcaccttcctgctcttcgccgtcttctggaacgtcttcgcctacgacctgctgggcgcccacatccccccaccgccctgaccggctacctgaggctgcacaggccagggctcgggcatgtggtggccgcccaccaggggccttcacgtctgccctttgtgaacggacgtctcagggctgctgtgccccttgggtgtgggtggcctcaaaggaggccctgtcccagccacccaccccccactcccaggacttgcggtctgagcctttttggataattaataaatattttacacagca

SEQ ID NO: 5636 - DNA, 1463 bp, Homo sapiens
ggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctgatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccagatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggctggagcagctggggttcaacgccctcctgcagctgatgatcggggtgcccctggagatggtgcacggcctgctccgcatcagcctgctctacctggcaggcgtgctggcaggctccctaaccgtctccatcaccgacatgcgggccccggtggtgggaggctccggcggggtctacgccctgtgctcggcacacctggccaacgttgtcatgaactgggctgggatgagatgtccctacaagttgctgaggatggtgctggccttggtgtgcatgagctccgaggtgggccgggccgtgtggctgcgcttctccccgccgctgcccgcctcgggcccacagcccagcttcatggcgcacctggcaggcgcggtggtgggggtgagcatgggcctgaccatcctgcggagctacgaggagcgcctgcgggaccagtgcggctggtgggtggtgctgctggcctacggcaccttcctgctcttcgccgtcttctggaacgtcttcgcctacgacctgctgggcgcccacatccccccaccgccctgaccggctacctgaggctgcacaggccagggctcgggcatgtggtggccgcccaccaggggccttcacgtctgccctttgtgaacggacgtctcagggctgctgtgccccttgggtgtgggtggcctcaaaggaggccctgtcccagccacccaccccccactcccaggacttgcggtctgagcctttttggataattaataaatattttacacagca

SEQ ID NO: 5637 - DNA, 1566 bp, Homo sapiens
agtcgtccgcagagcagcccctcccggccgcggccgccgaccccggaccccggcccccggccaggctctatggacaggagctcgctgctgcagctcatccaggagcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctgatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccagatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggctggagcagctggggttcaacgccctcctgcagctgatgatcggggtgcccctggagatggtgcacggcctgctccgcatcagcctgctctacctggcaggcgtgctggcaggctccctaaccgtctccatcaccgacatgcgggccccggtggtgggaggctccggcggggtctacgccctgtgctcggcacacctggccaacgttgtcatggtaacgggcctgcccggtggggggcgtggggaggggccccaggtgagcctcaccacttctcgtctgcacacacccatagaactgggctgggatgagatgtccctacaagttgctgaggatggtgctggccttggtgtgcagtgagtaggggccggggggagggccggggggcctctcagcctgcagccagggcacctcccacctgccgcgtccctctgcagtgagctccgaggtgggccgggccgtgtggctgcgcttctccccgccgctgcccgcctcgggcccacagcccagcttcatggcgcacctggcaggcgcggtggtgggggtgagcatgggcctgaccatcctgcggagctacgaggagcgcctgcgggaccagtgcggctggtgggtggtgctgctggcctacggcaccttcctgctcttcgccgtcttctggaacgtcttcgcctacgacctgctgggcgcccacatccccccaccgccctgaccggctacctgaggctgcacaggccagggctcgggcatgtggtggccgcccaccaggggccttcacgtctgccctttgtgaacggacgtctcagggctgctgtgccccttgggtgtgggtggcctcaaaggaggccctgtcccagccacccaccccccactcccaggacttgcggtctgagcctttttggataattaataaatattttacacagc

SEQ ID NO: 5638 - DNA, 2129 bp, Homo sapiens
gatagggtctcgctttatcactcaggatggagtgtagtgccacgatcttggctcactgcaacctccacctcccgggttcaagcgattctcctgcctcagcatccccagtagctgggattaaaggcatctgccacctcacctggctaattttttgggtacttttcgtagagatggggttttaccatgttggtcaggctggtctcgaatgcccgacctcaggtgatccgcccgcctctgcctcccaaagtgctgggattataggcgtgagccaccgcgccctgcccgagtcaggtttttttattgcaaaagatgggaactgattctggctaattaaatcaggaaatgaattttattgaaagcacattgagtaagttacagaatcacttgaaggctgtagaaacaaggcttgggaaaaaagcagaaacagagaccaggtacctagaattacaccaaattccatcacagagccagataggtgaggacagcctcagtgctgctgctgctgaacgcccagtgctgctgcctttgtcacagccacagctggcgttggatgctggatgccatgctgaccccagtggcaaggcgtctggacactggatactgctgccactgctgcaaccactgtaaagaattttttccatcctcacctccagcctcagaaatcctaagcaaatgcagctgattggtcaagctgccctagctgcctagggacatgcaaaagtgaatattgggcatggttaatgtctgtagtgggatccgtttcctgctgcccaccaggagaagataaattccccaagaaaactgacaaatgacgactacgtacatgttgtcaaagaatccactggaagtctttgacatttgcagattcaacacttgcaattttggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaa

SEQ ID NO: 5639 - DNA, 1286 bp, Homo sapiens
ttgaatgcagctaggcaagcggcacaagctcacaactaaaagtgtctgccatggaaaaggagttgtcataagggtgttggccttgccagggccttcctgggtgaggcgaagaagggaaggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcat

SEQ ID NO: 5640 - DNA, 1837 bp, Homo sapiens
agagcgggatcttcagggcagcgggcaaccccttggcccaggaagcctggaacgcaaggaccggagggcgtgggctgggacgcccctaccttggtctttcagggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaagaagaagagagaaaagaagggtagtaaaaactagagattggggccaggcgcagtggctcacgcctgtaatcccagcactttgggaggctgaggcgggtgaaatcacctgaggtcatgagttcaagaccagcctgaccaatatggtgaaaccctgtctctactaaagaaaatacaaaaattagccgggcgtggtggcgtgtgcctgtagtcccagctacttgcgaggctgaggcaggagaattgcttgaacctgggaggcgaaggttgcagtgagccgagattgcgccactgcactccagcctgggtgacagagcgacactcggtctcaaaaaacaaaacaaaacaaaacaaaattagagattgggtctttcccaggcatatggtattctataaaacagacttactctccttggaggatatattttggagaatgcttcataaaatctatgaatactgtacaatgctgataataaaaactttttatacctg

SEQ ID NO: 5641 - DNA, 2118 bp, Homo sapiens
gatagggtctcgctttatcactcaggatggagtgtagtgccacgatcttggctcactgcaacctccacctcccgggttcaagcgattctcctgcctcagcatccccagtagctgggattaaaggcatctgccacctcacctggctaattttttgggtacttttcgtagagatggggttttaccatgttggtcaggctggtctcgaatgcccgacctcaggtgatccgcccgcctctgcctcccaaagtgctgggattataggcgtgagccaccgcgccctgcccgagtcaggtttttttattgcaaaagatgggaactgattctggctaattaaatcaggaaatgaattttattgaaagcacattgagtaagttacagaatcacttgaaggctgtagaaacaaggcttgggaaaaaagcagaaacagagaccaggtacctagaattacaccaaattccatcacagagccagataggtgaggacagcctcagtgctgctgctgctgaacgcccagtgctgctgcctttgtcacagccacagctggcgttggatgctggatgccatgctgaccccagtggcaaggcgtctggacactggatactgctgccactgctgcaaccactgtaaagaattttttccatcctcacctccagcctcagaaatcctaagcaaatgcagctgattggtcaagctgccctagctgcctagggacatgcaaaagtgaatattgggcatggttaatgtctgtagtgggatccgtttcctgctgcccaccaggagaagataaattccccaagaaaactgacaaatgacgactacgtacatgttgtcaaagaatccactggaagtctttgacatttgcagattcaacacttgcaattttggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatg

SEQ ID NO: 5642 - DNA, 4661 bp, Homo sapiens
accccgtctcggccatgggcgagcaccccagcccgggccccgcggtggccgcctgcgccgaggcggagcgcatcgaggagctggaacccgaggccgaggagcggctgcccgcggcgccggaggaccactggaaagtcctgtttgatcagtttgaccctgggaacacaggctacattagcacaggcaagttccggagtcttctggagagccacagctccaagctggacccgcacaaaagggaggtcctcctggctcttgccgacagccacgcggatgggcagatcggctaccaggattttgtcagcctaatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagggtccttggcagtgtctgtggctgacatgaccgctccagtcgtgggctcttctggaggggtgtatgctctcgtctctgcccatctggccaacattgtcatgaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgtttgtgtttagatttggacacacagtggagacccttttctgaaaggcatctggcggaggagttgatgtggctgctgtcgtttttctcggctgctctgatgacatcgggccagggtgaaggtctggggtggggtgtgagagtggccctccctcacctgggctgggcttcttccatggggccagggggtgccccctcactgctgcggattgagcagcagcttcttcctcctcctctaccctcagagaccctaagagacatgggaaggctcgaaggttgttgcgtccaggcatggcccctctctagctcagaaataattgcaggccatgtggtgtctccttgacacctgctgtgtctggggctccagtaagaagagggcctactggacatgtcagctgtgacctggctgaaaccagggtgccctcctgggctggttggtgtgcaccggggcatgatctgttgtgcctgggttgggcagagcagggagcctgtaggctctaggacccctcttgtgctgggggtacccagtgagagggacccatgcagggggaataaacttcattccaagttccaccctggagaagacagacccaggaccagcttcagacttctccctccctttcttccaggatattggcatctcacacgggtgccccagcctccatgcccagccttgttttagggtctttttctttccttttgctgccctgacactactttgtgcctctctttggttatggagacagtgttttgaaacattcatgcgtgtgtgtgtgtgtgtgcgtatatgtgtgtatgtgatgggaaaggtaactgaggcacgacagcgcctgcagagaaggcatggaggatgcagggggcccatgtgggcatccgtgagaggtggcagaccgtggtgtgctgtggttgctgaatgtccttgctttgacaaagcctgcccccttccttcccatctcctgtcccttccacacctgcccctgagcatcactgaccggtggcagaatggccctgctggagggagagctcaagccctccaaggatccctggatgctgaggtttgccaggttcagctcttgtttccgtctgagatggccttcatatccaaaaaggttccatcctatctcccttaggagagaaagagctttgggggcgcaagagaggctggggtaggaatgttgaggccatgtgtccatttaagttagggggacaggaggctacaggaagaggaattccagtttagttggaaaactttgcctcaggagaattgttgggtgcatggatgaacctcagagggagggcagccagtagcctcggaggcttggatgcgggagagaacatggtggttatcaaatccaccccaccccattacacaggtgagaaaacaagatggagggaatgaccctcctaacaggagctggtgcaggccccgaatggagggcatgaggatgacctttgacaaaagatgacactccctttatcgtgctcttggaattctcaaccactgacagcccagaagaacaaagaacgccaggcctgggaggaggcaggggggctgggcgtgtccagaaacaggggcaggagtgtgggaacggtcttcctccagcctggtgcccatcctggcccttgagtgtagcagggtccagggtcagtcaggccaggcatttggggtcttgggccacagtggcttcccatcctggtgactacatgtaaatgggctcactcactcactggcaggcgaggcccagccataccgcatcttggcccactgctaaatagattgccctggcctcatccacatatgtagttccctaggtcctgctcccctgcaccagtgccatgctgagggccgcagcctgtggcactgtgggcccacgcctttggcggtgttgcgtcagcctggggcgtcttgtgtgtgccctgcccaccgttctctgccctagtgatagaaagatgtagatggaagtcagtgcctcagaggaggaggctctgaggctgtggagctgggctcagggaagaccaggggaggatgcagaaggagtcaggacattgctgcctctgcctgggctgcagccgcactaagctgagcgatgaggtcctttcctggagggatggagaatcccctccagattcctgtcctggcccctggggattctgtggtgtgggtggaatgagcagagtgccacctctgtctggtatgacctggagagggggcttcctctcttaggggtgagaaagcattgaactagaagattctagaaatccctcatagaagcactcagctccctcggggactcccagggaagcttgttactgagaaggacagtggaggcggaatcgtgtctcccaccatgttaagtgtgtcctctgctgccaaggaccctcgtctacaccttagaccaccagccccagctgttctctgtcagcacacccacctccatcccctctcccaaccatgacttccaagcggggccacagggtggggtcatagggtcacttcacctgacccaggcctctccccaggtcaggaggcagctgtctggtcagaggggttctctttgtggcatctggctttctcctcagcaggtcccaccaccctctcagcagcacttccccatggccaaggctggccgtgtcctctgtgcctctttccttgtctgaggtggctgccagcccagggggtggtgtgtaaatcttcaggctggtggaggtaggttggccttttatccacaggatacagaaactgaaagctggggaatccccaaacagcagccatagactcactggctctcattaaacgggagaggaatcacagaaactggggaagggaaaacaaaccttcaaaggagaaatttcgctttaatgacaccattcatcattcgttttttaattaggaaaagctccctaatgaggctcttttgccagctaataggactctcgatttccatgagaaccattcttgcccagaggattaggggagctgttgctcaccacaccaggatcttcccccagcgtccaatttaatttgcaaatacgtaatgcagattccctgggtgccgtgaaagcctttcctggcatcattcatgttgctccccgtgctggctggaaagcacggttctcctctgccttaaaaacagtgcccaacagtgaactgcccctccgaggacttgagtaagtggaaaaaacaaaacacagactgcaatgtttgtttctaagtatttttgtattgtgtacattctgtatatttttgttgtaacatattatttgagcacagattccattaaatattttttttctttttccaagc

SEQ ID NO: 5643 - DNA, 4560 bp, Homo sapiens
accccgtctcggccatgggcgagcaccccagcccgggccccgcggtggccgcctgcgccgaggcggagcgcatcgaggagctggaacccgaggccgaggagcggctgcccgcggcgccggaggaccactggaaagtcctgtttgatcagtttgaccctgggaacacaggctacattagcacaggcaagttccggagtcttctggagagccacagctccaagctggacccgcacaaaagggaggtcctcctggctcttgccgacagccacgcggatgggcagatcggctaccaggattttgtcagcctaatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgtttgtgtttagatttggacacacagtggagacccttttctgaaaggcatctggcggaggagttgatgtggctgctgtcgtttttctcggctgctctgatgacatcgggccagggtgaaggtctggggtggggtgtgagagtggccctccctcacctgggctgggcttcttccatggggccagggggtgccccctcactgctgcggattgagcagcagcttcttcctcctcctctaccctcagagaccctaagagacatgggaaggctcgaaggttgttgcgtccaggcatggcccctctctagctcagaaataattgcaggccatgtggtgtctccttgacacctgctgtgtctggggctccagtaagaagagggcctactggacatgtcagctgtgacctggctgaaaccagggtgccctcctgggctggttggtgtgcaccggggcatgatctgttgtgcctgggttgggcagagcagggagcctgtaggctctaggacccctcttgtgctgggggtacccagtgagagggacccatgcagggggaataaacttcattccaagttccaccctggagaagacagacccaggaccagcttcagacttctccctccctttcttccaggatattggcatctcacacgggtgccccagcctccatgcccagccttgttttagggtctttttctttccttttgctgccctgacactactttgtgcctctctttggttatggagacagtgttttgaaacattcatgcgtgtgtgtgtgtgtgtgcgtatatgtgtgtatgtgatgggaaaggtaactgaggcacgacagcgcctgcagagaaggcatggaggatgcagggggcccatgtgggcatccgtgagaggtggcagaccgtggtgtgctgtggttgctgaatgtccttgctttgacaaagcctgcccccttccttcccatctcctgtcccttccacacctgcccctgagcatcactgaccggtggcagaatggccctgctggagggagagctcaagccctccaaggatccctggatgctgaggtttgccaggttcagctcttgtttccgtctgagatggccttcatatccaaaaaggttccatcctatctcccttaggagagaaagagctttgggggcgcaagagaggctggggtaggaatgttgaggccatgtgtccatttaagttagggggacaggaggctacaggaagaggaattccagtttagttggaaaactttgcctcaggagaattgttgggtgcatggatgaacctcagagggagggcagccagtagcctcggaggcttggatgcgggagagaacatggtggttatcaaatccaccccaccccattacacaggtgagaaaacaagatggagggaatgaccctcctaacaggagctggtgcaggccccgaatggagggcatgaggatgacctttgacaaaagatgacactccctttatcgtgctcttggaattctcaaccactgacagcccagaagaacaaagaacgccaggcctgggaggaggcaggggggctgggcgtgtccagaaacaggggcaggagtgtgggaacggtcttcctccagcctggtgcccatcctggcccttgagtgtagcagggtccagggtcagtcaggccaggcatttggggtcttgggccacagtggcttcccatcctggtgactacatgtaaatgggctcactcactcactggcaggcgaggcccagccataccgcatcttggcccactgctaaatagattgccctggcctcatccacatatgtagttccctaggtcctgctcccctgcaccagtgccatgctgagggccgcagcctgtggcactgtgggcccacgcctttggcggtgttgcgtcagcctggggcgtcttgtgtgtgccctgcccaccgttctctgccctagtgatagaaagatgtagatggaagtcagtgcctcagaggaggaggctctgaggctgtggagctgggctcagggaagaccaggggaggatgcagaaggagtcaggacattgctgcctctgcctgggctgcagccgcactaagctgagcgatgaggtcctttcctggagggatggagaatcccctccagattcctgtcctggcccctggggattctgtggtgtgggtggaatgagcagagtgccacctctgtctggtatgacctggagagggggcttcctctcttaggggtgagaaagcattgaactagaagattctagaaatccctcatagaagcactcagctccctcggggactcccagggaagcttgttactgagaaggacagtggaggcggaatcgtgtctcccaccatgttaagtgtgtcctctgctgccaaggaccctcgtctacaccttagaccaccagccccagctgttctctgtcagcacacccacctccatcccctctcccaaccatgacttccaagcggggccacagggtggggtcatagggtcacttcacctgacccaggcctctccccaggtcaggaggcagctgtctggtcagaggggttctctttgtggcatctggctttctcctcagcaggtcccaccaccctctcagcagcacttccccatggccaaggctggccgtgtcctctgtgcctctttccttgtctgaggtggctgccagcccagggggtggtgtgtaaatcttcaggctggtggaggtaggttggccttttatccacaggatacagaaactgaaagctggggaatccccaaacagcagccatagactcactggctctcattaaacgggagaggaatcacagaaactggggaagggaaaacaaaccttcaaaggagaaatttcgctttaatgacaccattcatcattcgttttttaattaggaaaagctccctaatgaggctcttttgccagctaataggactctcgatttccatgagaaccattcttgcccagaggattaggggagctgttgctcaccacaccaggatcttcccccagcgtccaatttaatttgcaaatacgtaatgcagattccctgggtgccgtgaaagcctttcctggcatcattcatgttgctccccgtgctggctggaaagcacggttctcctctgccttaaaaacagtgcccaacagtgaactgcccctccgaggacttgagtaagtggaaaaaacaaaacacagactgcaatgtttgtttctaagtatttttgtattgtgtacattctgtatatttttgttgtaacatattatttgagcacagattccattaaatattttttttctttttccaagc

SEQ ID NO: 5644 - DNA, 4470 bp, Homo sapiens
atgtcagaaacatccgaggactacagagaccttggtgataagtgtgtctttctttctctcctcttcttcctctcctgcatggcctccctctctgccagcactggaaagtcctgtttgatcagatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagggtccttggcagtgtctgtggctgacatgaccgctccagtcgtgggctcttctggaggggtgtatgctctcgtctctgcccatctggccaacattgtcatgaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgtttgtgtttagatttggacacacagtggagacccttttctgaaaggcatctggcggaggagttgatgtggctgctgtcgtttttctcggctgctctgatgacatcgggccagggtgaaggtctggggtggggtgtgagagtggccctccctcacctgggctgggcttcttccatggggccagggggtgccccctcactgctgcggattgagcagcagcttcttcctcctcctctaccctcagagaccctaagagacatgggaaggctcgaaggttgttgcgtccaggcatggcccctctctagctcagaaataattgcaggccatgtggtgtctccttgacacctgctgtgtctggggctccagtaagaagagggcctactggacatgtcagctgtgacctggctgaaaccagggtgccctcctgggctggttggtgtgcaccggggcatgatctgttgtgcctgggttgggcagagcagggagcctgtaggctctaggacccctcttgtgctgggggtacccagtgagagggacccatgcagggggaataaacttcattccaagttccaccctggagaagacagacccaggaccagcttcagacttctccctccctttcttccaggatattggcatctcacacgggtgccccagcctccatgcccagccttgttttagggtctttttctttccttttgctgccctgacactactttgtgcctctctttggttatggagacagtgttttgaaacattcatgcgtgtgtgtgtgtgtgtgcgtatatgtgtgtatgtgatgggaaaggtaactgaggcacgacagcgcctgcagagaaggcatggaggatgcagggggcccatgtgggcatccgtgagaggtggcagaccgtggtgtgctgtggttgctgaatgtccttgctttgacaaagcctgcccccttccttcccatctcctgtcccttccacacctgcccctgagcatcactgaccggtggcagaatggccctgctggagggagagctcaagccctccaaggatccctggatgctgaggtttgccaggttcagctcttgtttccgtctgagatggccttcatatccaaaaaggttccatcctatctcccttaggagagaaagagctttgggggcgcaagagaggctggggtaggaatgttgaggccatgtgtccatttaagttagggggacaggaggctacaggaagaggaattccagtttagttggaaaactttgcctcaggagaattgttgggtgcatggatgaacctcagagggagggcagccagtagcctcggaggcttggatgcgggagagaacatggtggttatcaaatccaccccaccccattacacaggtgagaaaacaagatggagggaatgaccctcctaacaggagctggtgcaggccccgaatggagggcatgaggatgacctttgacaaaagatgacactccctttatcgtgctcttggaattctcaaccactgacagcccagaagaacaaagaacgccaggcctgggaggaggcaggggggctgggcgtgtccagaaacaggggcaggagtgtgggaacggtcttcctccagcctggtgcccatcctggcccttgagtgtagcagggtccagggtcagtcaggccaggcatttggggtcttgggccacagtggcttcccatcctggtgactacatgtaaatgggctcactcactcactggcaggcgaggcccagccataccgcatcttggcccactgctaaatagattgccctggcctcatccacatatgtagttccctaggtcctgctcccctgcaccagtgccatgctgagggccgcagcctgtggcactgtgggcccacgcctttggcggtgttgcgtcagcctggggcgtcttgtgtgtgccctgcccaccgttctctgccctagtgatagaaagatgtagatggaagtcagtgcctcagaggaggaggctctgaggctgtggagctgggctcagggaagaccaggggaggatgcagaaggagtcaggacattgctgcctctgcctgggctgcagccgcactaagctgagcgatgaggtcctttcctggagggatggagaatcccctccagattcctgtcctggcccctggggattctgtggtgtgggtggaatgagcagagtgccacctctgtctggtatgacctggagagggggcttcctctcttaggggtgagaaagcattgaactagaagattctagaaatccctcatagaagcactcagctccctcggggactcccagggaagcttgttactgagaaggacagtggaggcggaatcgtgtctcccaccatgttaagtgtgtcctctgctgccaaggaccctcgtctacaccttagaccaccagccccagctgttctctgtcagcacacccacctccatcccctctcccaaccatgacttccaagcggggccacagggtggggtcatagggtcacttcacctgacccaggcctctccccaggtcaggaggcagctgtctggtcagaggggttctctttgtggcatctggctttctcctcagcaggtcccaccaccctctcagcagcacttccccatggccaaggctggccgtgtcctctgtgcctctttccttgtctgaggtggctgccagcccagggggtggtgtgtaaatcttcaggctggtggaggtaggttggccttttatccacaggatacagaaactgaaagctggggaatccccaaacagcagccatagactcactggctctcattaaacgggagaggaatcacagaaactggggaagggaaaacaaaccttcaaaggagaaatttcgctttaatgacaccattcatcattcgttttttaattaggaaaagctccctaatgaggctcttttgccagctaataggactctcgatttccatgagaaccattcttgcccagaggattaggggagctgttgctcaccacaccaggatcttcccccagcgtccaatttaatttgcaaatacgtaatgcagattccctgggtgccgtgaaagcctttcctggcatcattcatgttgctccccgtgctggctggaaagcacggttctcctctgccttaaaaacagtgcccaacagtgaactgcccctccgaggacttgagtaagtggaaaaaacaaaacacagactgcaatgtttgtttctaagtatttttgtattgtgtacattctgtatatttttgttgtaacatattatttgagcacagattccattaaatattttttttctttttc

SEQ ID NO: 5645 - DNA, 1338 bp, Homo sapiens
ccccgtctcggccatgggcgagcaccccagcccgggccccgcggtggccgcctgcgccgaggcggagcgcatcgaggagctggaacccgaggccgaggagcggctgcccgcggcgccggaggactttgaccctgggaacacaggctacattagcacaggcaagttccggagtcttctggagagccacagctccaagctggacccgcacaaaagggaggtcctcctggctcttgccgacagccacgcggatgggcagatcggctaccaggattttgtcagcctaatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagggtccttggcagtgtctgtggctgacatgaccgctccagtcgtgggctcttctggaggggtgtatgctctcgtctctgcccatctggccaacattgtcatgaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgttt

SEQ ID NO: 5646 - DNA, 2383 bp, Homo sapiens
taatgaagcagggccagactttcagataaaggtggaagtgtatagttgctgtacagaagaatcttctataaccaacacaccaaaaaagctagctaagaaactcaagacatctataagtaaagctacaggaaagaaaataagttcagtgcttcaagaagaggatgatgaaatgtgcttgctcctcagctctgctgtttttggtgtaaagtataatttgctagctcacactaccctaaccttggaaagtgctgaggatagtttcaagacccataatctgtctattaatggaaatgaggagtcttcattttggcttcccctgtatggcaacatgtgctgccgactagttgcccagccagcttgtatggctgaggatgcatttgcaggatttcttaatcagcagcaaatggtagaaggtctgattagttggagaaggttgtattgtgttttgcgaggaggtaaactctattgtttttacagtccagaggaaattgaagctaaagtggaaccagctttggtagtacccattaacaagtcattagttttatttgaagacagtctcgaaggaattcaactcgccatatctcagtcctttaaggaaaccagaatccgggcaatggataaggatgccaagaaaagaatccataatttctctgtcatcaatcctgttcctggacaagctataactcagatttttgcagttgacaatagagaagatcttcagaagtggatggaagccttctggcagcatttctttgatcttagccaatggaagcactgttgtgaagaacttatgaaaattgagattatgtcaccacggaaaccacctttgttcttgacaaaagaggcaacctcagtctaccatgatatgagcattgattcacctatgaaacttgaaagtttaacggatataatacaaaaaaaaattgaagagacaaatgggcagttccttattggtcagcatgaagaatccttaccacctccttgggccacactctttgatggtaaccatcaaatggtcatccagaaaaagaataatagtaatcaactacataatctccagaaactgccagcaacttccaaattcctcttcacatagcttctcaaatacttcattagaaccagtgtgaaaaatttaaaatacaatgtgacatttctctagtagaatgtaagcttcatgagggaaaagacaacgcgtctccttcctgtattcctagcacccagtacggcacctgacacataatagtgaccttagaagaatatttaagagtcattgagtaaacattttgtagagctgtccatgtttattttccattcagtgtttaccaggtgtctgctatttggacagtcacttcattgttcattagtacatgactttggtaaatatatctcctgtgaagagaaatattataactactatggcattcaacactggtatttcagttactcaactaatccacccactgatggagtgaaccttgaattaaatgctttgaagaataaagtgaatcttgataaaaatcaaaggctgaagaaatcttgtttgacagaaggcatgaacaaaaatgctaaaattaatactgtttgtggagaaacactcattccaccgcagactaaatggagttcatgagtatcaaaatgcctatgtgatcaaaaggcagaaacagcttctttttactaggtctgttaatattccaggactcataatattgtgcctacatgagcacctgtgtttgtggtaactcaaagtatttgaacaccttatctcatccaacctcaaatttcctgtgaggtatttaagcaccgagagctcttggtactgttttcaagatgaagcagatgaattagagaggctgttcacacaccaaatttcacagaagcctatggaggaaatgacggggagacttaccagttaacacccagttgcagaaatcaatgtcagagcttgaaaggaccttataaacccctgatccaatgtggactttcctagtaagacttctgtttgcagtgacttggttcatttcaccaaccacaagaattttaagtaatttttaatcataaaagtaacatagaacatagtaatacatatatacgtacatacatgatacagaaaggtatcaaaaaacaaaaacatatattacttcctcctctaacattccagtgccagtttccaaagattcctattacccagaggtaaccactgttaataatttttaatgtatatttccaaaaattttttatgcatttagaaatgtgtgcatgtgggtgatgggtgcaccaaaatctcagaaatcaccactaaagaacttactcatgtaaccaaacaccatgtggtcccccaaaaacctattgaaataaataaataataacataataaagacttaat

SEQ ID NO: 5647 - DNA, 6641 bp, Homo sapiens
ccgggcggttggcgtcctctgcggctcctgccaggggcgggcttttcaaatcttccctttgaaggagtggcgacggcccggacagttcgcgttggagatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatatttaatgaagcagggccagactttcagataaaggtggaagtgtatagttgctgtacagaagaatcttctataaccaacacaccaaaaaagctagctaagaaactcaagacatctataagtaaagctacaggaaagaaaataagttcagtgcttcaagaagaggatgatgaaatgtgcttgctcctcagctctgctgtttttggtgtaaagtataatttgctagctcacactaccctaaccttggaaagtgctgaggatagtttcaagacccataatctgtctattaatggaaatgaggagtcttcattttggcttcccctgtatggcaacatgtgctgccgactagttgcccagccagcttgtatggctgaggatgcatttgcaggatttcttaatcagcagcaaatggtagaaggtctgattagttggagaaggttgtattgtgttttgcgaggaggtaaactctattgtttttacagtccagaggaaattgaagctaaagtggaaccagctttggtagtacccattaacaaggaaaccagaatccgggcaatggataaggatgccaagaaaagaatccataatttctctgtcatcaatcctgttcctggacaagctataactcagatttttgcagttgacaatagagaagatcttcagaagtggatggaagccttctggcagcatttctttgatcttagccaatggaagcactgttgtgaagaacttatgaaaattgagattatgtcaccacggaaaccacctttgttcttgacaaaagaggcaacctcagtctaccatgatatgagcattgattcacctatgaaacttgaaagtttaacggatataatacaaaaaaaaattgaagagacaaatgggcagttccttattggtcagcatgaagaatccttaccacctccttgggccacactctttgatggtaaccatcaaatggtcatccagaaaaaggtactgtatcctgcaagtgagccattacatgatgaaaaagggaaaaagagacaagctccccttcctccttctgataaacttccattcagcttaaaatcacagagtaacacagatcaattggttaaggacaactggggaaaaacaagtgtatctcagacatcgtctttggataccaaactatcaactctaatgcatcacttacagaaaccaatggctgctcctcgaaaacttctgcctgccaggagaaatagattaagtgatggtgagcacacagacactaaaaccaattttgaagccaagccagtgccagctccaaggcagaaatccatcaaagacattctggaccctagatcatggctgcaggcacaagtatagaaaactcttaatgataaaacatttaacaaaatctataactgtgaagcttaattcagaggcattatagaataatgtgtaattatataggtaaatatagtgatttataccaataattaataagctattaggtatagaaaaacattttataatgaagaagtggatttctcttttactcctgatttgcagaatgtaagtgatttctccagcagtgtgcaagaggcagtttctagacaatatcctaattgttggaagggttaatttattcctgaattagtaccaggcagtgaataagccctaggcagaataaagcattaaaatttcttttggggagagactgtctagtaatttaaaatgtgttaaatatgaaccatattctcattgtgagaattttaatactaatggaatgtttcaaaggttttattcaaaccacaaattatagaatccacccaagaaaattttcttagcattctggaattctcatctaatggttcactggctctcatctattgtttaactcactagtttataggcctgaccttttaaattcctgggataaattttagaatattaaattcttcatctttaaagggaatttgtaatgtgctattcaaacttgtttccttgatgagccctgaaatactgttgacattaactttcataaatgaagcataacacttactagtttagagaaatggtagatgaaatgctctttacattcaattttctgtgtgtggtgctaatttccattgtgactttggaatttagggaagtgagtagctgatcaacaccttaaaattcatttaatacttatttaaaaagaagatgagagattcaaaaatatcagaaaagttggccatggtaaataattttcagaattcttttttaaaattttaattagatttccttttcctagtaagagttgatgtctgctagtggtatttttcattaaatgtcatattcttacaacagtgacattggaatcatttccataggaggtaatttccatagcaactaatcatagtgacccaaacaggattataaagtcaagtgaggaataaatagcagaaaaataccttaaaggaacaaaaaatccattttttataataatgctttttgtaaacaagagcagaacagttttaaaaatctaattagaatttccaaataaaacagtttccataaggtgtcagcaacagcactaaaaatctcaaatcacactgaaccctaaatgtcattgcaagaaataaaaatttaagaattaaattgctgccctgtgtataatctcttgagatctttttaaagctagcaagaactctatttggatcagaactacattattacaaaacaaaatgaacacttgaccaaaaaaccacattaatttaaatggagcctttcattattttcagatagcggggtcttttccatttatagagaatgatgtaactgccaggacacttttgtgtttgcccaggactcctagtaagaattgaatcttgagggagtaatgataacaaaaggtttcttgtgactggtaacatcaggacagacagagtttttggtgagaagaaagtactatatgcctgcttgatagcatgtagagatcatcacatgtatggaaaccttaaaaagtaaacttattttttctaactagaaggctctcataagtttctgttatgattgccatttcaataaatgacattaaaaatctaaaggatattattgtttgaatttttgggttattttttaaaacttcattgctgtttttgacagcatttgtgactgtcattgccactaaattattgagctagaagatgctgcagggaaaattgttttgaagctggcatctaagcattcttttttttttcctagttgatgccttcctttattacaaatcagtattaaaacttccagattatattcttgtcatttttcctcatgcagataacagcaggaaggacttaaggtgtataagaaaaagaaagtattcatacagaaattacctagcagttgtgccctcagagtagaactttgaaacaggactgaagccctttttacctagaaccatttaaaagcctgagcaaggaccaccaccccctccccaccaaattattcggtctctttctggggggcccagcttactgtatgttacaagtctttgaaatgggtctggtgtcttcagctcctgaaatgctaatttaccccttacctaaggagtgtagttataatacagagttggtttccttccttccttccttccttccttccttccttccttccttccttccttccttccttccttccttcattccctctgtccgtctctccttccctccttccctccttccttcctttttgtctttgtttctttctctggccccctgtcctctctctctgtctcatccccttttcccactttccttctgtctctccttcctcccttcctttacagtttaaaaaaaaaatctaaaaatagttaagcactgtgtcaaagagtgtttcaaaagaattgtttgttttctcatttcttaaaccagaagtttatgacaaataaatatgccatgtaatatgaaagctgcttcagctttttatgagctttcacattccttgtttgtccttttaatttgtttcttgatatatgaagactataaacttgaaacaaagagttagctgtcagctcttgataatataattggggaaacagaatagatattttatgatatgataattctgatgatctaaagataatgtcttagacaattacctttacatttcaagctctgggatataaattacgtagtcagcattaagatagtattatttttaattgctactaagtggtaacttttgtattttaatatcttgcaagggcaaagaaggcatttttaaaattctaaatgcacacctcctaaggtaaatagtctttcaaaaatatcaggcgtgccaactcttgctgagttttgttaaatcctccttaactgtctgcagtgccccctgacttcttttaaatggatgtgaatatatgtggaaaactaaatccatttattataaatgccttatctttaccctttgggatcttactaaatgcattttacctgctactatttattaaaaatggaagctgtcttgaattagagatacctcacgtaaggtaggttaagcagtcaagtatttctttaggcttatgttcagcacctcagccccctactgagaagttaattaattcagtccaaaatgaaattatagggcagtttggtgcaatttatgttaaatgccatttgaatgtaatcacctgtgttaccacgaatgaggcacaactatactacatggacagagtactgcattgcaccatgagcaagaactgctctgcaagaaaaatatctgtccctgtggtctgaatttatcaaaactcattttcttgttaaagagtgaattattgaatagtaattaaactttaactgatgaccatttatattctagtagccatcttcactgttagtcttaaattataatgtaaagttgacattttccccttacatttcaaaggcatcactatttttaaatgtttacatatgtttacatgtttgtgtgcaactgcttcattgctattaatagttaaatgaaatctgcatattctggatcatagatgttcttagttaactctgggaaagatgttacctttgggtttttaaaagacaagtcatcatttgaaaatatattagggtgtgttgattttctgacatgcttgtgtaattggctttgtttataatttttattttttaatatgggtcagacttttggattaaaaagtattatatcatggacatacattttttaaagtaccaaaggtatttggtaagcgagcccaagtcatgtaattgaaacttctgtacattaaaagaactgattcatgaagacgttttctaactttttctctttaagtgctcctctagactagactgattgaagtagacagtgtggtggaatcagtttaatcagaaaaagacataccaagtagctggtgctaattattataagactaacattctgataagccatggtataattaacattattaaaatgtttacatataatccttcttaaagtatactcttttaaaaatccattgacataaccttacttttagtttagtgatccagaatttccccagagcttaagccactgcagtaaattaggtacgtaggatattcagtcgctactagccacaaggagtctccttattttaatgtacctccctcagtactttattcctgcagagcgcctcagagtgggggagagaaatgagcaatcctggctcagttggattatttcagcattttatttctaaatctgtagtgtgatcagaaatatttaaaattaaaaaaatactttacagagagaggcctactaatcaatgtgcttagagaaacaaactacctttacattcaattaacaacaaaaaaagttacagaaattttaacaaacatttttctttatctgagtatgggagaaaatactaatgctgacacgtttaataattagaaaagatcattccagatcttatggaaaattgtgttttaaattccagcagtttgctcttgagacatggtaatctcttaatgtaactactaaaggagaggtagattgaaaagatcttgtatatacataattatgtcagatggttcaagatatcaaaataaattgttttgttgaaaatgaa

SEQ ID NO: 5648 - DNA, 2076 bp, Homo sapiens
ccgggcggttggcgtcctctgcggctcctgccaggggcgggcttttcaaatcttccctttgaaggagtggcgacggcccggacagttcgcgttggagatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatattgtaagtattttttaatcttcagagaataaaaataatttaaaattcttcttttttaaaagaaagttcttattattggttctttggattcattttatgtttaaatgtttaagtgatctttaaatgtttaatatgattttaaaaatcattttgttcagaagaagtccatttctctatctgcagttttctgatgtgaaataaaaatggaaatcttgtaattactattagcagtaaatatttgacttattagatatgacccatttttaaattgttaataaatatagttcagttattaacaaagctatgcatacaacagaatatcctgtaatgttatttgatatagagagaatttaagcataaaacaggatttttatctcatgtaggatatttggttgcagaaatactaaaatagtatagcaactttatttacaagatagtcctgaagtacatgctatataggaagagcactttgaaattttggggtgttctttttcttatggtgcacttctttcatgtacttcaaagcaataaaaaaaaatgggtgatctcagggctgtttttattgtccctgctcttttacaggctcattttattgtggtcataatacagaacaagaaggaactccttgggtagccatagaaatcatttttaactaacatagtttttcctgccctccttcaaaggttctatgtgcctaaatcagtgtgggatttgtattttagacttttaaagacacgatctttagatctaaatgttaatagctactaactattaatataaaaatccatgtgcatggtttttgccattttcagctatggagctagacaggtgagattttagaggcctagttttgccactcacataacattaaaaaaacctatagtaaaccatattttgtagcttctggtccagtgtctcatagtaatagtatagcctggaaaaataaaatgcattgttctgagttataagtagtaattcaggccttcttacaagctgtattgaaccaaaggaatttatttaggatccaaaacatatccccaaatgcttatataattgaggctaaaaaaattacttttttcttggttatctgaatacatttatttccattatcaactattgctagtgaacttttttttctgccaaaattaccagttgatgggcccttttcttcacatcattttgctattgtttgttttgatcatggagacaaaaatcagacttttttttccagggaaagaacaatagaagttactgaggaagacaacacatgatttataattttttgagaattctgtaaatattttaaattgtactaaaaataactgctgacaaatgttctacatgttgaaaaatgtgctttttgttatgatgattgtttttaataagtattcaatatttatgaatctctggtttttctctaaatattgacatttgttagtcattaccaggaatactgcatgtttaaaagttgccaaataataaactataaaaata

SEQ ID NO: 5649 - DNA, 1681 bp, Homo sapiens
ccgggcggttggcgtcctctgcggctcctgccaggggcgggcttttcaaatcttccctttgaaggagtggcgacggcccggacagttcgcgttggagatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatatttaatgaagcagggccagactttcagataaaggtggaagtgtatagttgctgtacagaagaatcttctataaccaacacaccaaaaaagctagctaagaaactcaagacatctataagtaaagctacaggaaagaaaataagttcagtgcttcaagaagaggatgatgaaatgtgcttgctcctcagctctgctgtttttggtgtaaagtataatttgctagctcacactaccctaaccttggaaagtgctgaggatagtttcaagacccataatctgtctattaatggaaatgaggagtcttcattttggcttcccctgtatggcaacatgtgctgccgactagttgcccagccagcttgtatggctgaggatgcatttgcaggatttcttaatcagcagcaaatggtagaaggtctgattagttggagaaggttgtattgtgttttgcgaggaggtaaactctattgtttttacagtccagaggaaattgaagctaaagtggaaccagctttggtagtacccattaacaagtcattagttttatttgaagacagtctcgaaggaattcaactcgccatatctcagtcctttaaggaaaccagaatccgggcaatggataaggatgccaagaaaagaatccataatttctctgtcatcaatcctgttcctggacaagctataactcagatttttgcagttgacaatagagaagatcttcagaagtggatggaagccttctggcagcatttctttgatcttagccaatggaagcactgttgtgaagaacttatgaaaattgagattatgtcaccacggaaaccacctttgttcttgacaaaagaggcaacctcagtctaccatgatatgagcattgattcacctatgaaacttgaaagtttaacggatataatacaaaaaaaaattgaagagacaaatgggcagttccttattggtcagcatgaagaatccttaccacctccttgggccacactctttgatggtaaccatcaaatggtcatccagaaaaagaataatagtaatcaactacataatctccagaaactgccagcaacttccaaattcctcttcacatag

SEQ ID NO: 5650 - DNA, 747 bp, Homo sapiens
ttccccaggagcagttttggtttcagacggcgccgtctcccgcgaaagtcctgagaggagcccagccttttccgcctgccgcccccggatgggatggttgaggccggggccacgccccctctgcccccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaatctgctctcttc

SEQ ID NO: 5651 - DNA, 810 bp, Homo sapiens
aacaaaccggaggccctcgctcttccaatactcacgccctagctacagaggtcaaggaaggtttccccaggagcagttttggtttcagacggcgccgtctcccgcgaaagtcctgagaggagcccagccttttccgcctgccgcccccggatgggatggttgaggccggggccacgccccctctgcccccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaatctgctctcttca

SEQ ID NO: 5652 - DNA, 1071 bp, Homo sapiens
cccctcgacctccttttaaaaattctcttagccacgttgattgtacgggaaaagcctttttaaaacatcttttacgttgcttaaacctacagtttcgaaagcattccgaaggctaaagtgagaaataagcccaggctagggagaggagaaacgaagttcacgtcctagtctggcaccgggttggattgtcgctgggacggcagtcaggcatttggtgtggtcgcctaaggggtgggtccttcggcgggagctccgggaaaccccgtgggcctgcgcggcgttcttccttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaacatttattgttgggttttattgcagtaaaaagaatggtttttaagcaccaaattgatggtcacaccatttccttttagtagtgctactgctatcgctgtgtgaatgttgcctctggggattatgtgacccagtggttctgtatacctgccaggtgccaaccacttgtaaaggtcttgatattttcaattcttagactacctatactttggcagaagttatatttaatgtaagttgtctaaatataa

SEQ ID NO: 5653 - DNA, 705 bp, Homo sapiens
aagacccagactcttccctaggctgggagagactcggcggttgaaagcagggaggcgctacaggagagaaagggctgaacccccgcttccgcagatttcacctatttttcagtttgcctggagcaggccacgcaaattcccttcccttgaaggcccaaggagcgtctggtagattgctgattctctgcccatcaccgcttctggaagtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagtt

SEQ ID NO: 5654 - DNA, 796 bp, Homo sapiens
ggcgttcttccttttcgatccgccatctgcggtgggtgtctgcacttcggctgctctcgggttagcaccctatggtgccttctcttgtgatccctgacctaacctgtctcttccttttcctcaacctcaggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaacatttattgttgggttttattgcagtaaaaagaatggtttttaagcaccaaattgatggtcacaccatttccttttagtagtgctactgctatcgctgtgtgaatgttgcctctggggattatgtgacccagtggttctgtatacctg

SEQ ID NO: 5655 - DNA, 422 bp, Homo sapiens
gccacgttgattgtacgggaaaagcctttttaaaacatcttttacgttgcttaaacctacagtttcgaaagcattccgaaggctaaagtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattat

SEQ ID NO: 5656 - DNA, 2254 bp, Homo sapiens
cgccgacgaagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacgtggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctg

SEQ ID NO: 5657 - DNA, 1802 bp, Homo sapiens
aagcgtccggagccggatgcggaaatcggtgcgcgccgacgaagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcagatatgtgcagcgggggctacagcgagtggggctagatccccagctgccactgaatctggctgcccttcaggcccacgtggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctg

SEQ ID NO: 5658 - DNA, 4038 bp, Homo sapiens
cgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgc

SEQ ID NO: 5659 - DNA, 4399 bp, Homo sapiens
gccagaagaagaggaagtgaaggctacagggtatccacgtgggttctgagcgtgtttctacgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 5660 - DNA, 4242 bp, Homo sapiens
agtaatgcacacgaatccggaagtgacgccagaagaagaggaagtgaaggctacagggtatccacgtgggttctgagcgtgtttctacgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgc

SEQ ID NO: 5661 - DNA, 3493 bp, Homo sapiens
gtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgc

SEQ ID NO: 5662 - DNA, 7771 bp, Homo sapiens
actgtcaggtgacgcttccggcgcagaaaaatggcagccgccgctccggactcacgtgtgagtgaggaagaaaacctgaaaaagaccccaaagaagaagatgaaaatggtaactggagccgtagcgtcggtgctggaagacgaggccacagacacttctgatagtgaaggaagctgtggatcggaaaaggaccacttttattctgatgatgacgcaatagaagctgacagtgagggtgatgctgagccctgtgacaaagaaaatgaaaatgatggagaatcaagtgttgggactaatatgggctgggcagatgctatggctaaagtcctcaacaagaaaactcctgaaagtaaacctactattctggtcaaaaataagaagctggaaaaggaaaaagaaaagttaaagcaagaaagactagagaaaataaaacagcgtgataagaggctggagtgggaaatgatgtgcagagtaaagccagatgttgtccaagacaaagagacagagagaaatcttcagagaattgcaacaaggggtgtggtgcaattatttaatgctgttcagaaacatcaaaagaatgttgatgaaaaggttaaggaagctggaagttctatgagaaagcgtgctaagttgatatcaactgtttccaagaaagatttcatcagtgttttgagagggatggatggaagtacaaatgagactgcttcaagcaggaagaaaccaaaagccaaacagactgaagtgaaatcagaagaaggcccaggttggacgatcctacgtgatgatttcatgatgggagcatctatgaaagactgggacaaggaaagtgatgggccagatgacagcagaccagaatctgcaagtgactctgatacataaagcatcataggaaatacaattgcagtcgttttattttttctagaaaaatatgtcatcctctgatagttggggaattataaggataccatttgtaagaaagccaaaagacttttgccagatttcatatttccccttttcatgtacactttatatatacttcattaaaattatattttaaacccttgtataattttaagcattgttcctcagaacatttgtaaaaggatatatttctgcttgaccagcgagatgtgcattttgccaggatcatattggtcatgtctattggtgtattatttcagtatcaccaatgttttcagaaatacagtactaattcatcattaaactctttgaagttaatatttttctgccttctaacttatagactcaactatgtatctgtagtttttgggaatggttggtgttttttgctttgtgttgggaagttattgagaaaacctatataataaaatttaaaattatagtttttcagattttgggtcgtgattttagttttaggtaatctggaagatatgatttaagaaacaacagatttcaactttttttttttttttttttttttttttttttttttttttgagacggagtcttgctctgtggccccggatggaatgcagtggcgtgatctcggctcactgcaagcaccgcctcccaggttcacgccattctcccacctcaacctctcaagtagctgggactacaggtgcctgccaccacgcccagctaattttttgtttttgtatttttagtagagacggggtttcaccatgttagccaggatggtctcaatctcctgacctcgtgatccacccgcctcggcctcccaaagtgctgggattacaggcgtgagccactgcgcccggcccagatttcaacttttattttatttcctttcatttattaaataatataaataatgacagatttattttaggtgttagcctatttttgcatgagagatttacagaggtggaaattctcatgcttaacttatgcaatgagacaatttctcaggaagcaagtttgacatgctttagtctctctcttcttttttttcctcccaaatatttgagttagcttaaattcttttttatggactgcccaaccagtgaattgatgcacttagacaacaagtaatctgcagcagaatattgcatccaatttgagacttgattccatattattgccttaaaggctattaaattgggtgacttttagtatccagctgttaaaaagaggaaagactgtttaatatcattccaaaatttttgtgaaatgtggcccaagatctaaagtttttaagggaattatttttaataaatatgatctgtccctttttgaaaaggatccatcccttttcataataaaaataattccctcctaccacccagttgcacatacttgcatctgttatgtattgaaggataatcccccccaaaaaaactatccaagagcagagatgtttatattttgaaacccatttgagtgttacagtattatatgactaaagctgaatcagtctgtggcctggtatttgttatcataaaggaagatgtacacctaaggtatcaagtggttaaaacagcaaagtacaagatgcatttttgtatttattctaacttttgaacattagtgtctttcagtataaataaatgtgaacaaatatacctcagtagtaatacaggagaactaaatatcctgctataacttaatacagatacatatttcaatatgacttaacaaacacacaattttgaaaaaaaaaaaaaaaaagtgcagcaacttaaacacatttttctccccagaactaagattacacttaatttaatttaatgtgtttctgcgttatactagagttttgcaggaatttttctgaatagtacattcacatgatagatacggataaataccttatttactaaaatgttttgaaacatattttatagtccctcatttgatttgaaaaaatttgacaagatcttcacattgaaagtaaggacgagaatatttgcagatttccttcgttccaaaattattttattccaaagaaaaattgagttgccactatcaggaaaaaaaaaatgtatcacttctgttagaaggctatgaagtatatataaattatatgacaatttttatcatatagatttgatatcttctatgtattcgtatttttgcatcttgggtattaagcaaaataccatatgtataaatatgaaaccaggaatgtgcatattttagaaactaattgtgtatcttaagtgaatgttttgagtagttctgtcacccctattctaaatattttacctacaacatttaaattattctgatatcaatcagataaataatccgagtgtatttcatctttctacattgtctttgtggtttttgtttgtttgtttttgagacggtctcacactgtcacccaggctggagtgcagtggtgcaatctcagctcactgcaacctccacctcccaggttccagctatcctcccacctcagcctcccaagtagctaggactacaggtgtgcaccaccatgcccagctaattttttgtctttttgatgtagatggggttaccccatgttgcccaggctggttgtgaactcctgagctcaagggatccccccgcctcttgcctcccaaagtgcttggattacaggtgtgagccaccataccacctgtctttgaattttttaacgaggggaaagaaaactgcaattcctgcctccccatttatttaaacataacacctaggattttatttttggtaactacttagaataatatagtaggttacttatcttcggttagaaagaactatggaaaataggaaccaataatttggaagtattatttccttatttcatatatagaaataattatcttatttccttatttcatatatagaatattctagatacttggatggctggggttgatgttcttagtatttatcatagtttagcattggttgttatttttaagcatcagaatttgaaagccaatgataatacctgattaggactgaaaatagaattatcttagtagtttagcactttttataatggagttggagcactgaatttattttcaaattacctagaattctgcattgctcaaacattattcaattgattgcaaaatataccttggaaaccctttggatagaacagttcagagggttaccactagtacttagagcctaaagtcactcagtaggaggttctcaaaggtctatttgaaggcaatccaatttctttaaaataaaatattttttgccttttaaaacagatgggtgaagaaagggacgtataaattctgggaaacctcttatgttttcctcccatttccttctatgtctccattaatgtgctaacttgaaggaatttaacttcaaggaaagttgactgatgaagtttatgtagagctgtgaatattataatttgtcaatactttattgataatgttaactttgtttttatttggaaacattttttccagttgaccaaagcagaattcattctgttcttccctcaaattcatctattaggatcaatgtgattgacatttatctccactctgcatgtcactgatatggtatagacgctataagccctgtagatattatgggtatgaagactatttgaggtgaattggcagtgagagcaaattttggaaacaggagagagaactacttcgtgcctataaaaagctctctcactccttccccaagaaaacaggagtctgaattttggccagctgggtatttgaatcttactgactgttgcagcactggtagtcctggtaaattttttcagtgggcgagcttttctgaaatttgattaaacatattagtcaagggaatctgtgaatagatttagaagtagaatgtttgaggtggttgacaagacatttagaattgtgattaatgttttaataaaatgctaagttagaatgaataatcataattatatagatggaagatatattctaacagttcttaaataattttagattctctaaatttagagtgttttctagcttagagagcaatattaatattttttacctagtctactgaacataatttcagggagttagtatttaggactttttacctagagatgcggtaaaccttttaaatttaaatttgctttcttaaaatacctgttccaacattgctcacctttcttctccctcctttttgccctctccttcagtgggaggagcacatattcagctttctgttaaacactctttggttttcaactgagtaaggcaagcaaggatatatgttagaagagtgggcataatactttatattaaaattatagggactaaaagtctaaatcattgctgtcaataggactttttttgatgatggaaataatttatgtctgtgctgttcaatatggtagccactcgcagaggtgactactgagcatttcacgtgtggcttgtgatacagaggaactaaatttttaattttacttaattactttaaattttaaaagttacacgtggctagtgggtctatcccaactatgaagagaataaagctacagagcatctatctagtctaatgaaacaacagtgaatttgggaattgtaaatctgtcttaagctttttccataaacttttattgatataatttaggcatatacaaatactggtgaaattttattgattgaattattgttgacttttttttcagtatttatatttttaaaaagatatgtttctttataattaacttgtattgtagggtaaccattgtccttaaatgttaagccacttagttaataacaaatagcatttggttttttagcattatttatcatctgaggctttcagaattaatgcaccaaaccttaaatatttttgttgttctctaaaagaatgggtttatgatgcaccaaaaggacattttgagaactgccggagcaacagataccaccatgtaaggagtgaattcccatgtttttcacttatatctagaggcctacttatttaggaggtttcctaagtaagtgtatttagttgtaggaccttagagttgcctaggtccattctattctagcatatactcaacatactgccagagcaaatgtaggttgcagattcaggcaaaacacacacacacacacacacaaaaccctgaagagcacaatgagcattattagcacagccaatttaaaatgatgaggtgttaaccacatttgtataaataatagtttctctaaccctgaatcattatcctgcatttttaatgcaatcggttcataaacatcaaagtgaaaacaccaaatttgtaagaggtcaggaccaactggggctctaaatggagagacagctgagagctgtgtccctatgcgtgggtggccttgcagctgttgattcaccctcaggctaccagacagttgcctctttgcatttgcagaaccagacttcaatcttaggtaaaaatgtatccctcccatggacaggacataaacaatagattgacatcagctctgaaaacagtgcagcagccagactcagcagttgccctgaaatactgagaagtaccaagcataacatcaagactgtttctacacaataatatttgtctttgtacagcaacactgggttctcttaagtatattataaatataaaagctcaaagtccaaaaggttcaatgtgatgatatccttctctacaaatgccaggaacaccagggtagattgcatgagacatgactgccgtatcttggtccttactaggattcccaaatatactccttaataaccagtaaagttatatttacactggacattttaagaaataccagtgttcgttgttagatgagagacagcataattttggaatcacaactgagttcagagttcagttttgagtcctactagttttgtttccttgtgtaagtttcttaacctttgtaaggctagcatgtaaatcagatacaataatatatagttcagggtgtaaagattggattaatgtatgcagtgtctatctagcacagtgcctgttatgtagtagcgtgtcaagagatgttctctcttatgcatttggaggattaggtgctgcacctataggtttccattcatttctcatctatgtaattctgagtcttccttttctagatagaattccccccaacaaaaatttaaagtctaacaggtggtaggtgcttattgaggcccagcaattctacttctggaaaccttcctcaggaaaagattctgatgacagaaaatgctgtgtgaacagtattatatagaattgtttttaatagcaagaaattttttaaaacttacaagttcagtgatatgaggacatttacataaactatcgaaccaccagtcttctgtcaattccttttaaaatgatggttgtgaagactgatgaaaacacagtgtcaatgatatgttaactgaaaaagtaagattaaaaacattatggatagtataagtttcttaaatgccaacaatgcatgaggtgaatagaataagacttttttttaaagaatgtaatttttgacagtctgaaaagacaggccttatatttatattgagaaaaatgatcctgacatttaatgagacactaaaacagtttttattttttgcttacttattctgttctagaatccaaactctacatactgtttaatagagcattattgatattagctgtattagatgactgtatgaagagtcctgtttgctagaatcctactttatcttttaagttttgctaattaccctgcaatgaatgttgaacataaaaaatttgactccctttccatgtgtccactgtttccttgtgccttttgattaataaaactttatttttaagtgagaa

SEQ ID NO: 5663 - DNA, 5588 bp, Homo sapiens
atcgccccgcccacacgccgcctgccaggcgtgagtcttcctcccgctctgcgccgtcgccccgcccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggtttccctgactccagacttctcagcctgccgagcgtactggaagacaacgctctctgctgagcagaacgcacacatggaggctgtcctgcagagaagtgccgcgcacatgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaagaaaatggtaaaatagtgtctctgagatgctggcatggccacctccacctgcagagccctgccaggtgccagtgagtgcttggcccgaggggtcaggccacagcagtggccggggtaagaactgaacctgcaaacctggggagaacagagggtccccagagcctcccaaccccctggagctgggctccgtccctggggctgctgggctggcacgtggcgccgggggctccatccctggggctgctgggtcggcacgtggcgccgggggctccgtccctgactggcctcttcacagctttgtgcagcaggctccaccttctggttcaggccaaggttgggcagaaagtgagttgggtttgctggggcttcctgggcgaccccggctctgaccgtggttccatcacgcctgaagtagtaacacttttcccttggtgcccgtggccagctagtgtattttctaatccatccaaaggtgaaacagacttggtctttgccttctgaagagtgtgcgactctgagtcatactgaattctttgtgtcacctccgacgcaaagattcgttttgctgtttatcagaagagaaaacacagattccataccttgtcagctcctatttagttcggcttccctcttaatgtcccagcccctgtgagctgtcaggttctaaattcagaattctctcaattctgtcaggttctgcactacgagtcagtgtcatccctccaagccctggctctctgccagtgcagcagggctgtgagaatcaagacggcacagggaaggcatctgtcccagcatttgcacatgacaggtgcccacggtgcaggagtagaatctgtggaagcagcagtggctttagttgctgtgccctgccacctcctccccaaaaaggagaagtgtccaagggatagcagacccgtagcactgagcggcctgccgtgctgaccactggatccaggccacgtgctgcagacagcggctgtgggcgagtgatgaggccactacccagaaagctgcatgtgcactgtgtggggtaaggacagtaggagatgctgctgcaagatgctgactcccttgtttttcttttcatttgtgctctgggactaagctgtgtataagtcatcaaatggcagaagcaagatttttcttttgagatctaggaaattatttgtttatactctacactcttatttcctatatcaggatggggaggccactacctcaggccagttaaactaagaagaaagaatttaaggcaatttgtaaggatagacaaaaccccacatgatggtatgagtaggagagagaaaaaaaaaagggagccagaaattaggttacaaagtgtacaccacacataaaggctgatgcctctgttacaccgtgagccaaatgtttatctctagggtttctggtagccagttgcggggtgtccagtgaaggggtgtacatgtctgtggttaatcatataggtcaggataatgaggtgatactgcagtgacaaatggcaaatctccctggcttacaacaaccagtttgcctcttattcttctaggggaccatcatgggctgaggtcaggccaaggccttttgtatctggtgttactggaacatggctatgtgaattcatttatgtacaagagacctccccatcctgatgtaggaaatgaatggtgatgatttacgagcgcaacatcctaaaaaacgtttttgtatttccctagcaagataacttcaggttacaaggctctggtacttgaccatgatgactccatgagaaaacagcagaacgccagctttgcaggtacctccacagcactgccgggctgggaacagggccagtgcttgcaccagcgctggagggggccacagcagagtaaagacagagtctgccatgcaggagtgcttcgcaggtcaggcactgctctgagtgctttgtgttaacctgccccccgccccctaacttgggaaaggtgttaaagaaggagagaacgccctcaatggtgtgtcctttgcatacacacctttgcatgcatctgatgtgcccaggctgtgttttattgttctagcaatttattgttacaaaacagattgctgccatcaatttgtctcaggtccttctagcacatctgacagggactagtgtctagagccatgaggacagagaccagaagggacaagaaggagtgggcagagggaatggaaggtagagttaggcccagagagccccaggctgctgcccagacctccacgcctgtgccggatgtggtgttggcatccatagcagtctcgcaaagttgttctcattttccaaataaggaatctgaggcccagggagaggtgaagtgctgcaggagatccaaccaggcgccggctcagtgcctcctagaaagaggagtgtgggcacgtttgcaggggatccaaccaggcgtcagctcagtgcctcctagaaagtggagtgtgggcatgtttgcaggggatccaaccaggcgtcggctcagtgcctcctagaaagtggagtgtgggcacgtttgcaggggatccaaccaggcgtctgctcagtgcctcctagaaagtggagtgtgggcacgtttgtaggggatcccaccaggcatcagctcagtgcctcctagaaagaggagtgtgggcacgtttcagagaaaactggcttaggcctccctgtttctggcgtggccttccctgggagcgagttagggacacggaagctcacccgcttctgaatgggtccactcctggggatttccgcggccttccctgggagcgggttagggacacggaagctcacccccttctgaatgggtccactcctggggatttccgcggccttccctgggagcgggttagggacatggaagctcaccctcttctgaatgggtccactcctggggatttccacggcctttcctgggagcaggttagggacatggaagctcacgcccttctgaatgggtccactcccggggatttccatggccttccctggatgatccactcctggggattttccgcagctctccagatgacgtgcacgcacactaaacacccagaagttagggaggcactgatccagtgaagtcctcagatcaaccttgtgagctttttacaagtacctgtcactgttaaactgctgatgaaatgtgaaacgacttcacaggttttcagtctgataagctctcctgtgtcactgtcccttaccttgttagtaaaggtcaatggttctcaaagttccgggcacatcccctgggggctcataaaaccagactgtcggccacttcagccttctggttcgctgttccttggtaatgcagatggcccagtaagcaactctacaaacattagaacattttgaggtagacaggggaacttaatcaccccttgtaggcccccagaagactggacccaacatccagcacaatgcctctcagccttggctgtgcatctgaaacacctgctgtttgaagacacctgggcctggagacgggccagagccaccttggtggtctgagtatgaggccagcattagaacctctgctctacgggtgactgccctgggttgatttttttccagtattatctttagtacagaatcttttcctctctaagggcctgagaccctctcttaggaatagaagtacagttttcttccccactccttttgtccagaaggaaaacctggttttacatcagaaacttgaggtactttgaaaatttgccagctgccttgaaggagagagggcttgagtgtattttgggggaagaatgaggggacaacagggcagggagaagggacagagctagaggaaggacaggcctgtgccacccaggccagggtaaggggagcagagaccttttggttcctggtttgtgacacaggaagggagggaactggggaggacaggtcatgatcagtgtttcctgattaaaaattttttatttttatttttaattatcatgggcacagagtaggtgtatatatttgtggggtacatgagatgttttgatacagacatgcaatgtgaaaaagcacatcatggagactggggcacccatcccctcaagcatttatcctttgtgccacaaacaatccgattatattgttttagttatttttaaatatgcaattaaattgttattgactatagtcacccttctgtgctgctgctctactgtggcctcaaagatcataaatgctgtgggtgctggcaagatactgaaataaattaattctgtatttct

SEQ ID NO: 5664 - DNA, 5666 bp, Homo sapiens
acacgccgcctgccaggcgtgagtcttcctcccgctctgcgccgtcgccccgcccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggtttccctgactccagacttctcagcctgccgagcgtactggaagacaacgctctctgctgagcagaacgcacacatggaggctgtcctgcagagaagtgccgcgcacatgaggcaccttttgatgtcccagcagaccctgaggaatgtgccaccgatagtgtttgttcaagacaagggaaatgcagctctagctgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaagaaaatggtaaaatagtgtctctgagatgctggcatggccacctccacctgcagagccctgccaggtgccagtgagtgcttggcccgaggggtcaggccacagcagtggccggggtaagaactgaacctgcaaacctggggagaacagagggtccccagagcctcccaaccccctggagctgggctccgtccctggggctgctgggctggcacgtggcgccgggggctccatccctggggctgctgggtcggcacgtggcgccgggggctccgtccctgactggcctcttcacagctttgtgcagcaggctccaccttctggttcaggccaaggttgggcagaaagtgagttgggtttgctggggcttcctgggcgaccccggctctgaccgtggttccatcacgcctgaagtagtaacacttttcccttggtgcccgtggccagctagtgtattttctaatccatccaaaggtgaaacagacttggtctttgccttctgaagagtgtgcgactctgagtcatactgaattctttgtgtcacctccgacgcaaagattcgttttgctgtttatcagaagagaaaacacagattccataccttgtcagctcctatttagttcggcttccctcttaatgtcccagcccctgtgagctgtcaggttctaaattcagaattctctcaattctgtcaggttctgcactacgagtcagtgtcatccctccaagccctggctctctgccagtgcagcagggctgtgagaatcaagacggcacagggaaggcatctgtcccagcatttgcacatgacaggtgcccacggtgcaggagtagaatctgtggaagcagcagtggctttagttgctgtgccctgccacctcctccccaaaaaggagaagtgtccaagggatagcagacccgtagcactgagcggcctgccgtgctgaccactggatccaggccacgtgctgcagacagcggctgtgggcgagtgatgaggccactacccagaaagctgcatgtgcactgtgtggggtaaggacagtaggagatgctgctgcaagatgctgactcccttgtttttcttttcatttgtgctctgggactaagctgtgtataagtcatcaaatggcagaagcaagatttttcttttgagatctaggaaattatttgtttatactctacactcttatttcctatatcaggatggggaggccactacctcaggccagttaaactaagaagaaagaatttaaggcaatttgtaaggatagacaaaaccccacatgatggtatgagtaggagagagaaaaaaaaaagggagccagaaattaggttacaaagtgtacaccacacataaaggctgatgcctctgttacaccgtgagccaaatgtttatctctagggtttctggtagccagttgcggggtgtccagtgaaggggtgtacatgtctgtggttaatcatataggtcaggataatgaggtgatactgcagtgacaaatggcaaatctccctggcttacaacaaccagtttgcctcttattcttctaggggaccatcatgggctgaggtcaggccaaggccttttgtatctggtgttactggaacatggctatgtgaattcatttatgtacaagagacctccccatcctgatgtaggaaatgaatggtgatgatttacgagcgcaacatcctaaaaaacgtttttgtatttccctagcaagataacttcaggttacaaggctctggtacttgaccatgatgactccatgagaaaacagcagaacgccagctttgcaggtacctccacagcactgccgggctgggaacagggccagtgcttgcaccagcgctggagggggccacagcagagtaaagacagagtctgccatgcaggagtgcttcgcaggtcaggcactgctctgagtgctttgtgttaacctgccccccgccccctaacttgggaaaggtgttaaagaaggagagaacgccctcaatggtgtgtcctttgcatacacacctttgcatgcatctgatgtgcccaggctgtgttttattgttctagcaatttattgttacaaaacagattgctgccatcaatttgtctcaggtccttctagcacatctgacagggactagtgtctagagccatgaggacagagaccagaagggacaagaaggagtgggcagagggaatggaaggtagagttaggcccagagagccccaggctgctgcccagacctccacgcctgtgccggatgtggtgttggcatccatagcagtctcgcaaagttgttctcattttccaaataaggaatctgaggcccagggagaggtgaagtgctgcaggagatccaaccaggcgccggctcagtgcctcctagaaagaggagtgtgggcacgtttgcaggggatccaaccaggcgtcagctcagtgcctcctagaaagtggagtgtgggcatgtttgcaggggatccaaccaggcgtcggctcagtgcctcctagaaagtggagtgtgggcacgtttgcaggggatccaaccaggcgtctgctcagtgcctcctagaaagtggagtgtgggcacgtttgtaggggatcccaccaggcatcagctcagtgcctcctagaaagaggagtgtgggcacgtttcagagaaaactggcttaggcctccctgtttctggcgtggccttccctgggagcgagttagggacacggaagctcacccgcttctgaatgggtccactcctggggatttccgcggccttccctgggagcgggttagggacacggaagctcacccccttctgaatgggtccactcctggggatttccgcggccttccctgggagcgggttagggacatggaagctcaccctcttctgaatgggtccactcctggggatttccacggcctttcctgggagcaggttagggacatggaagctcacgcccttctgaatgggtccactcccggggatttccatggccttccctggatgatccactcctggggattttccgcagctctccagatgacgtgcacgcacactaaacacccagaagttagggaggcactgatccagtgaagtcctcagatcaaccttgtgagctttttacaagtacctgtcactgttaaactgctgatgaaatgtgaaacgacttcacaggttttcagtctgataagctctcctgtgtcactgtcccttaccttgttagtaaaggtcaatggttctcaaagttccgggcacatcccctgggggctcataaaaccagactgtcggccacttcagccttctggttcgctgttccttggtaatgcagatggcccagtaagcaactctacaaacattagaacattttgaggtagacaggggaacttaatcaccccttgtaggcccccagaagactggacccaacatccagcacaatgcctctcagccttggctgtgcatctgaaacacctgctgtttgaagacacctgggcctggagacgggccagagccaccttggtggtctgagtatgaggccagcattagaacctctgctctacgggtgactgccctgggttgatttttttccagtattatctttagtacagaatcttttcctctctaagggcctgagaccctctcttaggaatagaagtacagttttcttccccactccttttgtccagaaggaaaacctggttttacatcagaaacttgaggtactttgaaaatttgccagctgccttgaaggagagagggcttgagtgtattttgggggaagaatgaggggacaacagggcagggagaagggacagagctagaggaaggacaggcctgtgccacccaggccagggtaaggggagcagagaccttttggttcctggtttgtgacacaggaagggagggaactggggaggacaggtcatgatcagtgtttcctgattaaaaattttttatttttatttttaattatcatgggcacagagtaggtgtatatatttgtggggtacatgagatgttttgatacagacatgcaatgtgaaaaagcacatcatggagactggggcacccatcccctcaagcatttatcctttgtgccacaaacaatccgattatattgttttagttatttttaaatatgcaattaaattgttattgactatagtcacccttctgtgctgctgctctactgtggcctcaaagatcataaatgctgtgggtgctggcaagatactgaaataaattaattctgtatttctaaaaa

SEQ ID NO: 5665 - DNA, 3477 bp, Homo sapiens
ggctccggccgcggccgccgctgatacacggttgtggagggtacggccgcggtctccggaggtggcgggggtgttggggacgggtgctgcgaccggcactgcccatccgagcgggacgggcgctgagtggccgggaggcagccgggtagccgcctggaggagcagtctcggggcctattattggttttttccctccgagaccgattccatctgcagagaccgcgacgccccatcctgggccgggccgcagtgcccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccgcgcagaacacgctgggccccgggcctggcccggccgagcgccgcgccctcctgacccgcggccgcgggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccgggggaagcgtccctcgttttgttcttccccgcgagctctccccgcgcccctctcctttctgtgcttaatggatgggggttttgagtttttcccctttatttttgtcggctcttgactgggaggcccggcgcgaggctctgcgtctctgcgtccctcgtcgccgcctcgcgcccgcgcggatcccgtcacctgcttccccgccggggatggccggccagtgacggcgccgggtggcccgcgcgtggacacggggccctcgcccaagctgccaccgagccgcggcccccgccctcgacccttctctctcccgtattccgagctctctggaaagagaggaaactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcatagcaaatgacagaagtcccttggtgggcaaaattcactgggagaaaatggttaaaaaggtgtcaagatttggaatacgtacaggcacatttaactgttccagtgatcccagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaagatta

SEQ ID NO: 5666 - DNA, 2625 bp, Homo sapiens
acgtctcgctccttggagcccagactgagggagcgtcgcgaaagttgcccgttttggaacgctcccatttggctctccaaagggaagaattggttaaatagttgcactgaaaataatgcgattcaaatttctcattttccaagaacgctcccttgctgaagcttgcaagggcacggtactcccctctccttgaccctgaaacgtgcagcaagtagataacctcctgatccctgacagtctccgcctgtgttgatgccccgccccctctgctggagtccgagccgccgattggctaggagcacttgagcagcggaagcagctggctcgcgcggggactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggtgcttgggccactcaggacccctctggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaagatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctg

SEQ ID NO: 5667 - DNA, 2370 bp, Homo sapiens
gtgaagatggcggcagtggtggaggtggaggttggaggtggtgctgctggggaacgggagctggatgagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaattagagacggggtttcactgtgttagccaggatggtctcgatctcctgaccttgtgatccgcctcggcctcccaaagtgctgggattacaggcgtgagccaccgcgcccggcagatttttacaacctattctgaagaaaatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggtgcttgggccactcaggacccctctggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaagatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctg

SEQ ID NO: 5668 - DNA, 1868 bp, Homo sapiens
agtttcggaaccccagccagctcacctctgcgccgctgaacccgatccgagcctccggcaaaggtttttccctcctcccccggccgagggcttctgcagcccgggcacccccgccccgcggcgccccacattcccccagcccggggcccttggcgcgtgcgctccgtgcggctgtgctccgcgggactttgtttgtttcctcctcgtccctctttgttgggctgaacaccagcctcgtcaaagccccccactccggagggagttcggcttctccagcagggcggctgcagcgcgctgccccgaccccgcctgcggcccctcacgccgctagtgctcccaccccgccctcctggcaccccgcctgcgtccgttcgcccgaggaagccaaccgcgacttcattgatgcacccattccagtggtgtaacgggtgtttctgtggcctgggactggttagcaccaacaagtcctgctcgatgccacccatcagtttccaggaccttccgctcaacatctatatggtcatcttcggcacaggcatctttgtcttcatgctcagccttatcttctgctgctattttatcagcaaactgcggaaccaggcacagagtgagcgatacggatataaggaggtggtgcttaaaggtgatgccaagaagttacaattatatgggcagacctgcgcagtctgtctggaagacttcaaggggaaggatgagttaggcgtgctcccgtgccaacacgcctttcaccgcaagtgtctggtgaaatggctggaagttcgctgtgtctgccccatgtgtaacaagcccattgctagtccctcagaggccacgcagaacattgggattctattggatgagctggtgtgagtgctgccgctacaccgagacctggagaagacctcttgcctcatggatgtctggtccctctgcacagctccaaccaacaggactgtagggtgatgacgatcactttcccagtgatgagaagggtggtctaggactgggcttctaccctcagtgcaagaccagtgccagatgtgcccccacttcctgcctcctgaagccttcttccctgctactccatgctggtggcctcacccatcaagaccactgtctcctggtactggactatctacctgccttgtccctgttctgggggaaggtgtccaccccgatcaagaacatggagaaagtcctctttcaaggctcccattaggaggatgagctgccttgacccagaagggatgagacgggctcttacctctctacaaccttccctccccttcccactccttccggagtaaggttagaagggaaggaaggaaagatcaaggaaccaagcgcctccacgggaggcgagggaggctctgtatgaaacagaagagcagggacataaaggaaaatgtcagtgtttacatgggacctatggaaacaaaggctggcgggcgccagctgactccagagtaagagagggcccttcccctgccaggacccacggtgctatccattcagtctcttcctcagttaatctcggagcttcctattccatgttgaggtttgtgggcccctctagaggagggctagttctatacttaaattgattcccaggggccttttttttttttttttttttttttttgatcaaaaggggtgtggggatgggggtgtctacggttaagcaacagatacctccttccctttgtaaatagtatttttatacttcatcctcgcctctcaggctttagatacgaaatctccagaatggaagggggtggggattttctgttcctccctggagtgggtgagggtgggagaaagttacatatttaaagaaaaataaatttaataacaagtttctctaacct

SEQ ID NO: 5669 - DNA, 2866 bp, Homo sapiens
cccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagagagaaagagagagtgggcagacatcgaagccaaacagcagtatcccggaagcactcatgcaactttggtggcggccactcagttttctctgccagtgtctggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttcca

SEQ ID NO: 5670 - DNA, 2843 bp, Homo sapiens
ctctttagtaggtcgggtgagtgtagtgtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccactttaagatccagtaaa

SEQ ID NO: 5671 - DNA, 1008 bp, Homo sapiens
gctagggccagatactacggtcagtcagcagctctgcctgtatgcttgacttgacttgacttgcacttattaaataactttgtcccagagagaaagagagagtgggcagacatcgaagccaaacagcagtatcccggaagcactcatgcaactttggtggcggccactcagttttctctgccagtgtctggtaaattcctctattttgtcctaatctgacaatagtaaatagtaaatttccaaaactgtcgtttcatcatcagtttcagcaccgtgggcagctgctcgggtcctctcttgttgccccaaacctgcccggctattactgttcgtcagtgatgcagcagaaacagtgaaaactgatgcattcctttcaacaatgatgtgtttgttctccaaggagaacatctgcagtttttgatacaatataaataagtaaggtggctgtgcctccaaagagttcttctggagaaacagatcaattcaagatttaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaa

SEQ ID NO: 5672 - DNA, 593 bp, Homo sapiens
agaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagctgaatcacgtgggtaaataagaaagtggaaagtggaacactaaagaacttgatctgtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaa

SEQ ID NO: 5673 - DNA, 586 bp, Homo sapiens
aagtacagatttctcaatgaagatgcacccattatttttccctttagtgtattttgattcgtgtcctgggagatcaggaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacat

SEQ ID NO: 5674 - DNA, 570 bp, Homo sapiens
tttgggacttaacccctgctagggccagatactacggtcagtcagcagctctgcctgtatgcttgacttgacttgacttgcacttattaaataactttgtcccagagagaaagagagagtgggcagacatcgaagccaaacagcagtatcccggaagcactcatgcaactttggtggcggccactcagttttctctgccagtgtctggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggata

SEQ ID NO: 5675 - DNA, 701 bp, Homo sapiens
cagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttggagagaaagagagagtgggcagacatcgaagccaaacagcagtatcccggaagcactcatgcaactttggtggcggccactcagttttctctgccagtgtctggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatag

SEQ ID NO: 5676 - DNA, 306 bp, Homo sapiens
tataataaaaaaaggaaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctg

SEQ ID NO: 5677 - DNA, 1130 bp, Homo sapiens
gcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagagagaaagagagagtgggcagacatcgaagccaaacagcagtatcccggaagcactcatgcaactttggtggcggccactcagttttctctgccagtgtctggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaaccaaaacataaaaaaaaaaaa

SEQ ID NO: 5678 - DNA, 2263 bp, Homo sapiens
cggcagccgcgcgagagggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctcgccctgctgacctgcagcctgtggccggcacgggcagacaacgcgagccaggagtactacacggcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaagtctgtgctgttgagtcttattaaccagacctgtgttttgagggctgatttgaagctcgcagacccagattgcatttgtttgtgtttcagagacagaatgtgctcctggctcccgtgagaggaacagggattgacacttactattggtgtcttcacattggctcctacccacatagggcgcaagagcggggacatcctgctggtgatgccgcttaggatggtcagttgatttactcattcttcaagggggacattcactctgtgataatttcttctctgtggttgatcagcctccaccagagctgcagcacccccagcagcagggacttgtaacatttgctccccactgtgcccctgcacccaacagagtgctttgcacatcgtaagtgctcaataaatatttgtggaatgaa

SEQ ID NO: 5679 - DNA, 1445 bp, Homo sapiens
aagcagtatctagagttaacagtaggggatttatttttcaatctaaagtttttcacctctctctagtaagacatctgaaactcataagccatctttaagaatttcttacaaaaacatgctggaagacagtggatcttgtttgtatcctgaagatttttttctcttcgttattttaaattaattgtcaacagatgtgcaactgttaggttggttcttaagtcactcggagaagagagagatgcatctactcaaggttggcacttggagaaacaacactgcctcttcctggcttatgaagttcagtgttctttggcttgttagtcagaactgttgcagagcaagtgttgtttggatggcttatatgaacatatcatttcatgttgggaatcatgtgttgtcagagttgggagagactggagtctttggaagaagctccactttgaagagagtggcaggagttatagtgccaccagagggaaaaatccaaaatgcatgtaatcccaataccattttcagccgatcaaagtactcagagacctggcttgcacttattgaacggggaggttgtaccttcacacagaaaattaaagtggcaactgagaagggagccagtggagtgatcatctataacgttccaggtactggcaaccaggtgttccccatgtttcatcaggcatttgaagatgtcgttgtggttatgattggtaacttaaaaggcacggaaattttccatttaattaagaagggagttctcattacagccgtggttgaggtggggagaaagcacatcatctggatgaatcactatttggtctcttttgtgattgtcacaactgctaccttagcatatttcatcttttatcacattcatagactttgtttagcaaggattcagaaccggagatggcagcgattaacaacagatcttcagaacacatttggacaactccaacttcgagtagtaaaagagggggatgaagaaataaatccaaatggggatagctgcgtaatttgctttgaacgctataagcctaatgacatagttcgtattctgacttgtaaacattttttccacaagaattgcattgacccctggattttaccccatgggacatgccccatttgcaaatgtgatattcttaaagttttggggattcaagtggttgttgaaaatggaacagaacctttgcaagttctaatgtcaaatgaactgcctgaaaccttatcacctagtgaagaggagacaaataatgaagtttctcctgcaggaacctcagataaagtaatccatgtggaggagaaccctacttctcagaataatgacatccagcctcattcagtagtggaagatgttcatccttcaccttgatggcatgacttttgaggaagtgtattaaacctgtatgtgaaatcaggtcctaatactgacaagcagtttgtctgtt

SEQ ID NO: 5680 - DNA, 5743 bp, Homo sapiens
gagcctcccgcgtgcccggcctctgtgcgcgctcgcgccccgcccgcgcagccgcttctccccgcgcgggctctcggcaggcgggaggcggcagggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagactgttctgcgatgaccacaacaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatcaaagaaggattagaaactgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacaggttgtgggcatttttgcaggatttgggctgctgctcttggtggcctcacctttcctactcctggccactccctttgtactttgctgcaagtgcaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcatttagtaaaatcctttttagaaggtattttttttccaactgagtagtgaaaatcaacaaggtgcatataaaccatcctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgtattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaaacagcgtcacctcactcttcacctgtcatgttgattttccttatgaacccgaagccatttagaaaatccctgtgtgtcaaaattacattcaaaaagctctccttgtaattgcaagtttagtaactcagtaagaacatgcctgcgactccctttctggatggaacctgggctgtggctctctgtcgtttgtggtgctgtgatggtgtctactgttagaatagcttttctggaggtgggtggcaactccacgcgggagtcattggctgggcttgagccctcagcctgtgatatgtggatgcagctgtccagccactgccctttaacatgcccagcacacatgggaggcctgtggccctgtgtccagtggcccacaggacacgcctccaccatatgctcatccttcctgcctgaaattgctgctgcccatcgcatgagcccacacagtagcacccccgtccttaggatgagagtcagagcctttggaaaggctgcatccccagggctagagctcagatgaccttatttctagagggacaggctgttctgttggaagagtctctggcccagtcatgcacatctgtagccccagccatccttgtgccttcacctctgatgtgtttcacaagcacgtagttcaacccagatagggaccacagagattctggggccagccaggggcagtcaaattggcacctactggctctgactttttgtatgaagcatgcctcagtttcctcattttgatctagatataaaattaaaattgtccatttcctatataaataccagcaagatcactctgagatacataaactcgcatttccttctgttttagtaaggagtgccagacttatctttgatgggaatacagtatgaaccctgcttgatgtaaaatggaaatagcacacaggcagatggccctgggtttggactttgatcttgccatcattccccagtaaaacctggggagttctgcgttgagtggacggacttattcctgtgaagcggcataatttgtctccattgaaaaatggcattcactcttacagatggtgttcactgcaagccccagaagcatatggcatgtgttcactaagaggcctttaatcctggggagtaaggggcgaaggcccttagacaaccatggctgctgtactgccgcccagggtgggtggccagtgaggactggccttagcccagtggacctgtggcttctctgaggcccttgagtaactgaccacatttggaggttttgctggaaatgcctgacctctcagtctggctctgctgtgtagtccatagcccagccagatgagcttgcagcctcataggaggtcagcaccttgcaaagatgcagtcaccatagatgtccacgtagcagagactgacttaggatctgagataaagcatcggattgcaggaataactgtccaaattagttcttcctcctcaactcataggagtagctgtggacagaggaaccaacatctgccacctctggcattttctttctttttttttctttttgagacggagtttcgcttttgtcccccaagctggagtacaatgacaggatctcggctcactgcaagctctgcctcccgggttcaagcgattctcctgcctcagcctcccaagtagctgggattacaggcacccaccacctcacccagctaatttttgtattttcagtagagacggggtttcaccatgttggccaggctactctcaaactcctgacctcaggtgatctgcccacctcggcttcccaaagtgctggaattacaggcctgagccaccccacccggcctattttcttaaaggggaacaaatgatcttgacaacatattattccataaaaccagtttagggcacaggccagttcctgattagaacacaggacctgtgggagggactatcagagatgcaaaaattacttcaagatgagtttattgttttcatttgtattgcaaaagttagaagtcattttacaaattaaaaaaacatttttttcttggtagtctttaaaaattaggggattgaaaggatccaggatgggctttgtgtgtgtgtctcagattctcatttattagtgagcacacctgtgtatatatataaatcacaaggagatcatcaagggaaaacattttgcatgtgtaaagcttcatgaagttctctttaaaaaataccaaagcttgtttatttctgataattaacctaagcccttatgaaaataaacaaaatgaagggattatgacaggtattaccaaaaacaccaaaaggaacaaaggggcctgcgttaaaacctaattgctaatgcttcacaactaggagagcatgccgtcttgatgtttaaaaaacccagggtctccacccttcctttgatttgtgcaattctgtcttccacagttccggagccttcagtgaggggtagctacatgccccatgcctgccctttctttccttctttgctcactttactatgggtgtattttaatcttgtataaaaatatgcatgaatgagtcatgcacatgtatacgttatgtatttgacaagtggtggtgaaacaaaatcaaaacagatttgatttgtgtttttgaaatgtcagtacattttgtgccactaacactgtgatgtataaaagagctgtttgaatgccttttaatgttgtgttttgtactctggaatcatatggaaaaagtttgatttgtaatttcaatacatattttaaatgtattgtgtcttacgtagtttgtccccccctttagcagggattcctttttaaagctattttggctggaatacaggtgacttttgtaaaccc

SEQ ID NO: 5681 - DNA, 564 bp, Homo sapiens
gtgaaaacctccacttatagcggctgcataagcttaactgcgcagagctatactgctttttgaaatactaacttgcaagttcagcaacagctaagaaaacaatcctagacttggaaattgaaagattggaagagaagtggagggattcctttggaaccctttacgtacgtatgtgtaaggaattgtaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagactgttctgcgatgaccacaacaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatc

SEQ ID NO: 5682 - DNA, 1446 bp, Homo sapiens
gcgcgggctctcggcaggcgggaggcggcagggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagactgttctgcgatgaccacaacaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatcaaagaaggattagaaactgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcattta

SEQ ID NO: 5683 - DNA, 392 bp, Homo sapiens
aggaaaggttgcatcagtttatgtgatcatgttcaagtccctcgaggttggactcagaaccaagctgaatgctcaggaaacaagtaggctggttctgcagtctgagcctggaccctgtctgtttggaggctttccttctctctttgtgaatattctctttagaagagagctctctttctgcacctgtggggatcatcaccaccatgtcagaactgaactgttctgcgatgaccacaacaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatc

SEQ ID NO: 5684 - DNA, 5036 bp, Homo sapiens
gagctgtgccccacgctcccgctgcaacagtcccgggcatcgcagctgccagtcaaggctaggaggcggtcggggactccgcctcctcccgacccgtaggtctgggagcgcaagtcctgttgcagtcttgcaaagtgtaaagctgtcagccgcagagcacggaggaaagacggagagaatggaagagctcctgtccggtgtgccagcagcccggactggcggtgagcgcgagggaggctactgagaagcccggcgacggaggaacgcaggtctgctgccagggattgaggagactgaagaatgctgaagacaggctgatgggctcagctggtaggctccactatctcgccatgactgctgaaaatcccactcctggagacctggctccggcccccctcatcacttgcaaactctgcctgtgtgagcagtctctggacaagatgaccacactccaggaatgccagtgcatcttttgcacagcttgcctgaaacagtacatgcagctggcaatccgagaaggatgtgggtctcccatcacttgccctgacatggtgtgcctaaaccacgggaccctgcaggaagctgagattgcctgtttggtacctgtggaccagtttcaactttatcagaggttaaaatttgaaagagaagttcatctggacccctaccgaacatggtgtcctgttgcagactgtcagacagtgtgccctgttgcctcgagtgacccaggacagcctgtgctggtggaatgcccttcttgccacctgaaattctgctcgtgttgcaaggatgcttggcatgcagaggtctcctgtagagacagtcagcctattgtcctgccaacagagcaccgagccctctttgggacagatgcagaagcccccattaagcagtgcccagtttgccgggtttatatcgaacgcaatgaaggctgcgctcagatgatgtgcaaaaactgcaagcatacattttgctggtactgcctccagaacttggataatgacattttcctcagacattatgacaaagggccatgcaggaataaacttggccactcaagagcatcagtgatgtggaaccgaacacaggtggtggggattctcgtaggcttgggcatcattgccttggttacttcacccttgttactcctggcctccccatgtataatctgttgtgtctgcaagtcctgtcggggcaagaagaaaaagcacgacccatccacaacctaaagatctctgtgttcatacgccccagatatgtgagttacatgagatggcacagtgataaagccccatttagtgaccttgcctccttctccttgccaactttgaaagtgcctccgtgtccagactttgaacttgcctgccagccttcagcatcaggaaaggccaagtcctgggtgtgagtgttcctgtgtaacaagaactgggctcaacggtccagctgtttctatggagctttggggttccttgagatgaatgaacatatcattttatcatccaaaggatctcactggactgttcaacttccagccaaattcaaggagcttgcgggaacatttgatataacaaatgtgttgtcattgttggcaacatacaagataaccaagaagctggagtctgttctgtgttgatttgactgccatgagaaacacaggggaaacctgatgaggagaaggataagactgcgtaaggagaaatcctcataggagctataaagcaggctgctgatctcagcagttgatatggtggttgtgcctctgctggctactgggtgtgctgtccccatgttcccgctgtgatttggcagaaacacaataggcttctccttgtgtgatctcagcttcaagcaggtgaaactgctgtgcagagggagttgccccttcccagtaaaagagttgcagcctgttaaacaatgtggtctaatttagtgtctctcccttggcaaatgtaagttttctaagttggccaacttgtctcttacagccagtggctgtggtctacagaattgtttcatataaaatacgggtagagtggtagagtttcaaaactttcgtcatagatatctgggacctttctcaggatctgtgttcacacagccaatagatttggaatcaggcctaagagtacacatggagggtaaatattaaagtgcgtattatgtacatctagaatccatgtgacttgcagcctacctgtaatttctatccattgagcatgcatggatatacccaatagtacacacaaaataaatgtttacttaagagccattctatccttttgtgactgaaatggtttattgtaaatctgcctaaagattttttgcatattatatatgtgaattttggttgtaagttcataacttacccaagggtatagactcataactcttttaaaacagtgcttagtacaatatcctgccatctctgtaaaaacgctaattgataaccgagtcatttacatgttttcgaacacagaatagctcttttctcagcatcattattgctctttcagcatctgttaggacagtctgaatactttctgtttcaaggcactgataaaaccgcaacaaaaacatgtaagaaataaaatagaaatgctttatataatttagtttaaatttatgtatcacctcattgtgacttattttttccattataccattagtcagatttgaataacgaggttttgaaaggataaaaccttttctccaatgacaggattatataattgctattggcaatgtagcctggtgcttcatgagacctatgctaaatgttactggagagttcttgaagccagggataccatatcaggaactattcaggatctatgatattttctgaggtaactgggtaatagaatatcaaattgctgctatctcggacctattgttaaaggatgatgctttgcctatgtaataggatatatcctaagtggggatgtgtatatttcaggaactttaattcacaagtatatattgatatctgatgtgtgtatagtacatctgttggttatgtacattttaatttacatgttgtgtagaacatagatgagaactctgggaaaacttgggaatggcaaccaaccaaaatcatttttaatcatttattagaaatttctcaatattgtgtctttttcttttgaaactctaaacacttcagaaaaaaacactatcagtgtagttcatgttagtataattatagatttacatatatttgaatagttaatttgctttgttttacacgtagcccactgcctcattataggtaaaaggcatttataactgctcaggggattacgagaactcaactgaaactgaatttttgtaacaagaatgttaatagtggcaaagtcctctgtcagtaaactctttaagcttggtgctgcaaagagtctttaaatgggggctgatttcaagtaacctaaaagactgtgttatcagaggaagaggtcccaaatttggagtaaagatgggagaaaataaatatgtgctatttccttggcgagttgagggaatttgccaccttacagagtttgtatcactgaattagctgcttttgtttttttttttttttttttgccagggctatggagtgggggttgtttgtcaaactgattttcaataattggatttaattttttttaacattgaaaagtgcctgaaaaatggtaaattcttaaatgtgtgtgagattgtcagaatcaacaaaactaggttggttaaacatatctctggtacatcaaggggcatgatacaaaccagtctaaagactgtttataaaggagagagctggcgacttatttttatttttattttttggacagagtctccctttgtcacccaggccggagtgcagtggcatgatcatggttcacttcaacccctacctcctgggctcaagtgttcctctcaccttatcctcctgagcagctgggactacaggcacacaccaccacacctggctaagttttgtattttttgtagagatggggtttctctgtgttgcccagtcttgtctcaaactcctgggctcaagcgatccacccaccttgggctcccaaagtgttgggattacaggtgtgtgtcactgtgcctgacagctgacagttttaactgacaactttgataacagaggctgctatttttgttttagataattggccagtgacagagtttacccttgcctcctttcttggtctgccagctttgtcctttctgagtgattctctttctgtattgagaggaagtgtgggtctacatagggatgtttggatgctatggcaagaatctttttgtgtttggagtgtagtccatttgcaatagaaataaaaaaatccgtcaccaaattgtaacctggatgttatagcccagcatctagaaatcctatgaaacgtattagcacaatatcttgccattgtcccatctaggaaattttttcttgttgtgaggtagggaagtgaggaggaaagccatgccgaagcaaatgttagaatcttaggcatcctatttgttcatgccatgggtatttgctttggacttggagtctgtactttgaaagaggcctttgaaaaacaaataattctgtgtgaattttcttgtagcgtgcttcatgaaaatatctacttatccaggtttgcaaatgtacatgttcatttgaatgtaaatcaccatttcttggaaccccacgttttttcttaaaaattattctgaattaaatgtatatttctttagccttccctacacagtactaataaaagacttttctttctgttcatgaatggatgcctttatgtgatatagagtcatgtgtgtatgtgtagctttaagggcaatttcagaaatgcattagatgaatgacattttataaagcgatcacaattgatatctacaggctattatgtctcatgttgattcatgatccaggaagttttatgtatttaaaaaattgctatcgtgttatatttttccaatttttggagaagaaaatagctgtttaggctctctagccacaataaatgtaagcaggaaatcaa

SEQ ID NO: 5685 - DNA, 999 bp, Homo sapiens
gtaggtgaggccgtcagcgctggtgaagagctgctgtgggatgagcccgtcctcaggcacgtagccggtgcagcagttgctcagatagtccgccatgctgcgggagaccccgcgaccccacgtaaacacccgcgcagccgctgctgctgctgctgttgttactgttgccgccattttttaaatataaaatatagtctaattcagggcatgctgtggatcacaatgcctcatcctgctcacttggggttatttattgccgtcacactttctgaagttcatctggacccctaccgaacatggtgtcctgttgcagactgtcagacagtgtgccctgttgcctcgagtgacccaggacagcctgtgctggtggaatgcccttcttgccacctgaaattctgctcgtgttgcaaggatgcttggcatgcagaggtctcctgtagagacagtcagcctattgtcctgccaacagagcaccgagccctctttgggacagatgcagaagcccccattaagcagtgcccagtttgccgggtttatatcgaacgcaatgaaggctgcgctcagatgatgtgcaaaaactgcaagcatacattttgctggtactgcctccagaacttggataatgacattttcctcagacattatgacaaagggccatgcaggaataaacttggccactcaagagcatcagtgatgtggaaccgaacacaggtggtggggattctcgtaggcttgggcatcattgccttggttacttcacccttgttactcctggcctccccatgtataatctgttgtgtctgcaagtcctgtcggggcaagaagaaaaagcacgacccatccacaacctaaagatctctgtgttcatacgccccagatatgtgagttacatgagatggcacagtgataaagccccatttagtgaccttgcctccttctccttgccaactttgaaagtgcctccgtgtccagactttgaacttgcctgccagccttcag

SEQ ID NO: 5686 - DNA, 3364 bp, Homo sapiens
agactccctgtctttgcggtttgggagatgatgagaaaccacagaattgctagtagtttatgtggagatcaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataa

SEQ ID NO: 5687 - DNA, 2658 bp, Homo sapiens
gtgggaggaggtgcggggagagaggaaggggcctgtgcagtgagcaggcatcaaagattagtggatggccttgcgtcgcagtctgcagtaaagaggaaactagtctgaaagggaaggagaggactgtgtgtctttttattttttaaaatacggagtgtgcagttttactgaatcttgaatcatgcccaaaagaatgagctgtcggtgctgcagtcgtgacccaggctgagcggccgatggcagaggtagtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaag

SEQ ID NO: 5688 - DNA, 3613 bp, Homo sapiens
agagcgccgggggcgggaggagcaaacgcaggaggccatggccgccgacgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataa

SEQ ID NO: 5689 - DNA, 2603 bp, Homo sapiens
attcattcatccagtcacttactccacaggggtttgagtgcctgcacttggtgctgggcacggctgagccatcccagacgccaaggagtttacagtctagtccagtcagtgacgaggttaaaacgaattctcgcatcattgctactgcgaatgcaccgggacaggatcagcccttcaaattctcccacgtggtccctgcaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagc

SEQ ID NO: 5690 - DNA, 3478 bp, Homo sapiens
agtggatggccttgcgtcgcagtctgcagtaaagaggaaactagtctgaaagggaaggagaggactgtgtgtctttttattttttaaaatacggagtgtgcagttttactgaatcttgaatcatgcccaaaagaatgagctgtcggtgctgcagtcgtgacccaggctgagcggccgatggcagaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataa

SEQ ID NO: 5691 - DNA, 2340 bp, Homo sapiens
acttagaattttaggctctagctttgtgctcttaacattttcagtgaggcctaccatcctaaccgatggacagcccgaaaatttacttttcttaagatcagttttagttgatggtagaatttttttttttaactggttgggagaaagaaaggagataatggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggg

SEQ ID NO: 5692 - DNA, 2655 bp, Homo sapiens
gtgggaggaggtgcggggagagaggaaggggcctgtgcagtgagcaggcatcaaagattagtggatggccttgcgtcgcagtctgcagtaaagaggaaactagtctgaaagggaaggagaggactgtgtgtctttttattttttaaaatacggagtgtgcagttttactgaatcttgaatcatgcccaaaagaatgagctgtcggtgctgcagtcgtgacccaggctgagcggccgatggcagaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaag

SEQ ID NO: 5693 - DNA, 2628 bp, Homo sapiens
ggccgcggccgccgcagagcgccgccgccgacgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgat

SEQ ID NO: 5694 - DNA, 1304 bp, Homo sapiens
gtaccaatcacaagtcttgttattttgtttcattatgagaaagataatctactaaatattaaaatactggaaggagcaagatagctttgatccagggagaccttttccatttatgtgctttagtaatctgccgccaacaagctatcttctttatgttcttctacaactgatgttgttttgttttctcatgtttgtctcttaatagacaaatggaggcatgagcttccttagaattaccccttcgacgcatagttctgtttcatctggacttttgaggcttagtatctttctactacttagctttcctgactcaaacggaaaagccatttggacagctcacctgaatataacatttcaggttggaaatgagatcacatcggaattaggagagagtggagtgttcgggaatcattctcctctggaaagggtgtctggtgtggtggcacttcctgaaggatggaatcagaatgcctgtcatcctttgaccaatttcagcaggcccaaacaggcagactcatggctggccctcatcgaacgtggaggctgtacttttacacataaaatcaacgtggcagcagagaagggagcaaatggggtgatcatctacaactatcaaggtacgggcagtaaagtatttcccatgtctcaccaggggacggaaaatatagtcgcggtgatgataagcaacctgaaaggcatggaaattttgcactcgattcagaaaggagtctatgtgacagtcatcattgaagtggggagaatgcacatgcagtgggtgagccattacatcatgtatctatttaccttcctggctgccacaattgcctacttttacttagattgcgtctggagacttacacctagagtgcccaattctttcaccaggaggcgaagtcaaataaagacagatgtgaagaaagctattgaccagcttcaactgcgagttctcaaagaaggggatgaggaattagacctaaatgaagacaactgtgttgtttgctttgacacatacaaaccccaagatgtagtacgcattttaacttgcaaacattttttccataaggcatgcattgacccctggcttttagcccataggacatgtcccatgtgcaagtgtgacatcctgaaaacttaagaaatctggagaattttctgaagatgtaaccagatctttccaaatacaaagattagataaattgtcttattgtactttatgtagagagaaaatttcagcttctctacccaagtatgaacaagggtgaaatttgtgttttaaaaataaaactccttatcatgcccagcta

SEQ ID NO: 5695 - DNA, 2458 bp, Homo sapiens
cgcctcagtcttccagggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgacagcagtccaccatcagcctcccctgctgaatctgagccacagtgtgatcccagctttaaaggagatgcaggagaaaatacggcattgctagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcacatgagcattaagttcttcattgccttgttaaggaaaatgagtaggcagactcagaatctgttatattgatttcagttacaatttaatctttacaattaaaagggcgaaagatgtagaattttagtttttgttgttgactcgaaataaccagttttcttgattagagtttaagcagatttaataccatgaccttgcttaaccgtttcttcttttttacttgcttgctgttcttttgggtcaaaggagcaggctaatgcaaagcttttggagactgctaagtgttaaaaagtgattaaacacacactctgctattttttcacttcttggaggtagaagtcgagtatgaggcagttattttttagagtgtggaattatagtctttccttgctcctagttattctgtatatctttactttgtaggtaaaaataaatgtttatttaaaac

SEQ ID NO: 5696 - DNA, 4535 bp, Homo sapiens
cacacacacacggaccgcttactccgctctgcctgctcgctcccactgtccccaagcccgccccgcccgcggcaagtgcgtgcccaggcgcagccaccggcgagatcaggagcgcagcgcccgcagcctgagggaaccggcgcagggcagcagcggctgcagctggattcgcgcgccccagcgctcagtggcggcggccgggacaccctgggcagcaccccgcaccgcagcaccccagactacgagcaatcgtgcccgtccccgccggggctggagggcgcagggccgccaccctgcaagttcgtgggcccccggccacccttatgagagaaggcgaagccgggcgaaggagcaggacgctcggcagcaggactcctccgcaagccccgcgggccctctgttcccgcgccccccgggcgcccaagaagcaaaatgcaaccaccgcgctacagctgagaggggaaggggccagcgccatccgctcgcccggaatccggtccccgcggcggctgcgcgtcccggccgcggcccctccggcccgggagtgagcagcagcaggaggagaggcagcggcccggggttggccggggctggggaggagggacgggacggagggagggcgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgtagaagacatcgtggccataatgattcctgagccaaaagggaaggagatagtaagcctgctggaaagaaacatcaccgtgacaatgtacatcaccatcggaacccggaacttgcagaaatatcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagcaggagccagctgtaagcagtgattctgacatttccttgatcatggcaatggaggttggactgtctgatgtagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggcctttaaaaaccccagctgccagagaccccaacactaagccctaaatctgctgaggccactgctggttattttaagccacatcacacttgcttccacttgccgggcttgattaagggcccacgtgacatgagaagggagctctagggaagccgtttcattcttctgggtcttacagtctttggctgaaattctgaactcagaagtcccctccaaggcatccagtctttggtggttgtagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttgcatctccctaggagtccaatgcttcctgtaatgaaatccactctctatgtgtgggaaaagaggcagggaggaatgaagagagctctgaatcgagaatcctagatgaaccacacgctttactaagcctcggcttcttcatctataatgtgaagggtttaataacatgagtccccaagctcctctggctgtgggaccacagatgagtctttcagaggcaggatccatttttgcagatagctatgacttgtggcaatcaggcttcgtagcttggggaggtagagttacttgacatgtatcatgtaataacagcctttgagacttggcacaactatggtgctgagaatgaaaatctaaatgattgaagttttaagtccaagtaggagttggtttgttttgccttgtttaaaaattgctgttagtcacagagtttgcaatctctggataccttcaaatcctagctctcactgtgggattcttgatctcagaggtgtttatttttcacagtcagcataggcttgcgccactgactcctccttcagtcggctttgcccaaaacaaattttagtattactggtattaagtttagtccagtggaattagaaggataattcaatagcaacagaaatataaattatattccattcccagagagagaatgcgctttggattgtttagtcctctgattaacgagtattttctcttcctgccaagaactaggtgaatcaggaattgattgcatatgcaagccctggccacagctgcacttacaggatgcctcatagacgatgaggggtctgaaaggccaacccgaggctggcagatctgaccccaaggaggtcctgctgcaaaccccctgagcctttgccattcactacttaccaaagtttgtttctggaggattttcctgtagctttgatagttt

SEQ ID NO: 5697 - DNA, 3584 bp, Homo sapiens
atgtcttctcatgcccagcccctgaagctgatttcaccatgcccatattccctttcctcaggtgtagaagacatcgtggccataatgattcctgagccaaaagggaaggagatagtaagcctgctggaaagaaacatcaccgtgacaatgtacatcaccatcggaacccggaacttgcagaaatatgtgagccgcacttcggttgtgtttgtctccatctccttcattgtcctgatgatcatttccctcgcatggctcgtcttttattacatccagaggtttcgatatgcaaatgccagggataggaaccagcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagcaggagccagctgtaagcagtgattctgacatttccttgatcatggcaatggaggttggactgtctgatgtagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggcctttaaaaaccccagctgccagagaccccaacactaagccctaaatctgctgaggccactgctggttattttaagccacatcacacttgcttccacttgccgggcttgattaagggcccacgtgacatgagaagggagctctagggaagccgtttcattcttctgggtcttacagtctttggctgaaattctgaactcagaagtcccctccaaggcatccagtctttggtggttgtagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttgcatctccctaggagtccaatgcttcctgtaatgaaatccactctctatgtgtgggaaaagaggcagggaggaatgaagagagctctgaatcgagaatcctagatgaaccacacgctttactaagcctcggcttcttcatctataatgtgaagggtttaataacatgagtccccaagctcctctggctgtgggaccacagatgagtctttcagaggcaggatccatttttgcagatagctatgacttgtggcaatcaggcttcgtagcttggggaggtagagttacttgacatgtatcatgtaataacagcctttgagacttggcacaactatggtgctgagaatgaaaatctaaatgattgaagttttaagtccaagtaggagttggtttgttttgccttgtttaaaaattgctgttagtcacagagtttgcaatctctggataccttcaaatcctagctctcactgtgggattcttgatctcagaggtgtttatttttcacagtcagcataggcttgcgccactgactcctccttcagtcggctttgcccaaaacaaattttagtattactggtattaagtttagtccagtggaattagaaggataattcaatagcaacagaaatataaattatattccattcccagagagagaatgcgctttggattgtttagtcctctgattaacgagtattttctcttcctgccaagaactaggtgaatcaggaattgattgcatatgcaagccctggccacagctgcacttacaggatgcctcatagacgatgaggggtctgaaaggccaacccgaggctggcagatctgaccccaaggaggtcctgctgcaaaccccctgagcctttgccattcactacttaccaaagtttgtttctggaggattttcctgtagctttgatagttt

SEQ ID NO: 5698 - DNA, 3673 bp, Homo sapiens
catgtgaagattgtgcttgctttccttccatcccttagccataattgcctgtttcctgagacctcctgtacagcctatggaactgtttaatgtcttctcatgcccagcccctgaagctgatttcaccatgcccatattccctttcctcaggtgtagaagacatcgtggccataatgattcctgagccaaaagggaaggagatagtaagcctgctggaaagaaacatcaccgtgacaatgtacatcaccatcggaacccggaacttgcagaaatatgtgagccgcacttcggttgtgtttgtctccatctccttcattgtcctgatgatcatttccctcgcatggctcgtcttttattacatccagaggtttcgatatgcaaatgccagggataggaaccagcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagcaggagccagctgtaagcagtgattctgacatttccttgatcatggcaatggaggttggactgtctgatgtagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggcctttaaaaaccccagctgccagagaccccaacactaagccctaaatctgctgaggccactgctggttattttaagccacatcacacttgcttccacttgccgggcttgattaagggcccacgtgacatgagaagggagctctagggaagccgtttcattcttctgggtcttacagtctttggctgaaattctgaactcagaagtcccctccaaggcatccagtctttggtggttgtagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttgcatctccctaggagtccaatgcttcctgtaatgaaatccactctctatgtgtgggaaaagaggcagggaggaatgaagagagctctgaatcgagaatcctagatgaaccacacgctttactaagcctcggcttcttcatctataatgtgaagggtttaataacatgagtccccaagctcctctggctgtgggaccacagatgagtctttcagaggcaggatccatttttgcagatagctatgacttgtggcaatcaggcttcgtagcttggggaggtagagttacttgacatgtatcatgtaataacagcctttgagacttggcacaactatggtgctgagaatgaaaatctaaatgattgaagttttaagtccaagtaggagttggtttgttttgccttgtttaaaaattgctgttagtcacagagtttgcaatctctggataccttcaaatcctagctctcactgtgggattcttgatctcagaggtgtttatttttcacagtcagcataggcttgcgccactgactcctccttcagtcggctttgcccaaaacaaattttagtattactggtattaagtttagtccagtggaattagaaggataattcaatagcaacagaaatataaattatattccattcccagagagagaatgcgctttggattgtttagtcctctgattaacgagtattttctcttcctgccaagaactaggtgaatcaggaattgattgcatatgcaagccctggccacagctgcacttacaggatgcctcatagacgatgaggggtctgaaaggccaacccgaggctggcagatctgaccccaaggaggtcctgctgcaaaccccctgagcctttgccattcactacttaccaaagtttgtttctggaggattttcctgtagctttgatagttt

SEQ ID NO: 5699 - DNA, 1530 bp, Homo sapiens
cgggcgcccaagaagcaaaatgcaaccaccgcgctacagctgagaggggaaggggccagcgccatccgctcgcccggaatccggtccccgcggcggctgcgcgtcccggccgcggcccctccggcccgggagtgagcagcagcaggaggagaggcagcggcccggggttggccggggctggggaggagggacgggacggagggagggcgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgtagaagacatcgtggccataatgattcctgagccaaaagggaaggagatagtaagcctgctggaaagaaacatcaccgtgacaatgtacatcaccatcggaacccggaacttgcagaaatatgtgagccgcacttcggttgtgtttgtctccatctccttcattgtcctgatgatcatttccctcgcatggctcgtcttttattacatccagaggtttcgatatgcaaatgccagggataggaaccagcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagttctgccatacttaaagtgacatagccagaaggactgttgccttgtaggaattggaaaaaaatacctttcctcaaaaagaaaaaaa

SEQ ID NO: 5700 - DNA, 1828 bp, Homo sapiens
cgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgtagaagacatcgtggccataatgattcctgagccaaaagggaaggagatagtaagcctgctggaaagaaacatcaccgtgacaatgtacatcaccatcggaacccggaacttgcagaaatatgtgagccgcacttcggttgtgtttgtctccatctccttcattgtcctgatgatcatttccctcgcatggctcgtcttttattacatccagaggtttcgatatgcaaatgccagggataggaaccagcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagcaggagccagctgtaagcagtgattctgacatttccttgatcatggcaatggaggttggactgtctgatgtagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcacca

SEQ ID NO: 5701 - DNA, 9501 bp, Homo sapiens
gtgcacgtgcgcgcgcgcccgccccagttgcgcccccggcccgcacacaccccggctcatcttctcccggtccccttgtctcgcgccttctccagccctagaagttgccccagggcccctcccgggattagagagcgctgtgaagggccagatgttgggggtcttttgtgcagacacacgcgcctggggcgcttgctcctggaaggacagcggcaggacaaagccagctggactcgtggggcgctgctcgggaagcggcggtccccaatcccgcctggggtcggggcatggcttggggagcgctgcctgggtctggagagagtagagaaatcgccaaagcagagtgacggtgacttgatgaggtgacggtgacttgatgaggtggcggtgacttgatgaggtggcggacaggggcaaacgaaagaaagatgctcgggattgccgcgctgtgtgcctgtctgcgcggctgactaggcgccccgcattcccatatgaccgggttacctggtagattttgccagtgtgtctttgccccaagatgttattccccacctgctccgatttctttctttcctagggcttactgttgctagtaggcgctctgccaccagaggggaactcgtgggcgggggagactgcggaggaggggggaggtggttatttatcctgtagagacaattaggagccgtgacgcccccttctcggccgccagccctccacacctcatctgccttgctccacctccctagtgcacccgctccagccccgtctgcccaggagggcgcttggatttccttctccgcggcgcgtatctaacccttcctgcatgtatttcactgcaggctgaagaaagctcagtctcaattgtgtttcctgcctgtcagcctcttgcctcctaaacgtgtaccatttccacttgatgtcatcacgcagaaggggtgaaagagactcggtgacagatacagaaatgaacacacctgtgagtactggatgcctgtgagcttgccattacctgcactgcaaagacacagggcggtggcctctgagaagcagctccttccccttcaccttggccttgcccttcctgctcacggtccaccatggagacgctgtcccaggactctctgctggaatgtcagatctgtttcaattactacagcccccggcgcaggcccaagttgctggactgcaagcacacctgctgttcagtgtgcctgcagcagatgaggaccagccagaaggatgtgcggtgcccctggtgccgcggtgtcaccaagctgcctcccggcttctccgtgtcgcagctcccggacgacccggaggtcctggctgtcatcgccattccacacacttccgaacacaccccggtcttcatcaaacttcccagcaatgggtgctacatgctgcccctgcccatctccaaggagcgtgcgctgctgcccggagacatgggctgccgcctgctgcccgggagccagcagaagtccgtcaccgtggtgaccatccctgctgaacagcagcctctgcaaggtggggctccccaggaggcggtggaggaggagcaggacaggcggggcgtggtgaaaagctccacctggtcgggggtgtgcactgtcatcttggtggcttgcgtcttggtcttcctcctcggcatcgtgcttcacaacatgtcttgcatttctaagcgcttcactgtgatatcctgtggctgaagagggctgcagggaagtctcttgtgggtgccaacttaggggttgagcaggttgatgatgagatcccagtgagaagatggggggcaacactgaccatttggtgctgagcgctggcctctgggttgcctcttgattaccccaagacagacacaaagggcagaaggtgcggtctcaacaagataccaggtgaattgttctgagtgttgatggcaacagcttggaagatgattgcatgcatcctcataatcatgtattcaatggactgtaatttatgatttttcaaaatcatgttacaagatagacatattctacttagacgttaaactgtacaagtgcgtacaatgtgaccttctctaaatgcggtagattcaaacaaagatgctctgtagacaagtagaattaaacctgcgaatccgtgtaaaaattcagtgaagacatgcactgctggcttctttattttttttttctttttattgaaacccagtcttcatttagttgctaaggcttttaatacattttgaatggcaccaaaacaaaataagtcaaaatggacagtcattttatttggaggaaatatttgaacaagtgtctccaatgtgttgtgttttgtcatgaaccttcattttcttcacttgtaattagagcttgctacgtgtttatggaactgaaagctcaacaggggagcaataaaccgagaaatcatgagaaatgtctaatcccatgggaaaacctgtatgccgattttcctcaagccatctcacaaaataagaatttcaaatgtaaatattgtgtatttgtgtgtgtatgtgtgtgtgtctaatttgatttacctcaggtgtttgagtctttgctgaagaatcctgggatgaagacttcattgggcatgaatgagtcaagtctctgaagcggtggccacttcttggacatcttgacccagcgagtggtctcctacacgtcacctgcaacactcgctcctcttctgtgtatttaagtcctgcattttgtaagaggcaaatggagagtaacagaagagtgtcttttctcctggttttggagtcttgcactggccatgagtgttgtgactgatggtcaacccaggcgggcattttaataaatggcctgtgattcttttttgaaagatgctcttccacaagagttaagccagttagaattcctgtttcctcttgttgatatgagagaagatctcctgtattttaacacgtttttaccaagaaaggtggcaaggtaaactaacagctcaaattcccaatataagtggaccagttcctcataaactgtcaaatgttcttaaatgtgtaatgatctatagatgctcatgaagaaagatctgctacaagtacgtgataaattcctatccctgggtgcatgtgcattcagaaatagctgtgagctttacagctctcatctaacttcttttatggaattcatgaagcaagtggtatgtgacaaggactccacttataaatataactgtttttatgttccactgaatccctgaaaatggtgaggagggtggggggaagtgaaggaaagacaagcagggctaattccaaaaagcaaggctagaaaatagccctgtgaggtcaagacaatttaatttatttacatgctgtctgttatcttcaagcagcacaaaatatgcatataaaagtgatggaattaatgtgaaataaaacaaaaatataatggctagaatacaaagctaatactgctaattggcatgagaattcaacataaaattgtgagctctgatttttcaaattgatcataaaacctttaggaaatgtatttgaaagctcaaaatagaaattaggttaaaatgccattttattgtgtaagctcttgggcattatacaacaaataatctaggatttatttggtattaataatttaggtgtcatattagctgaatactatcctctattacataacataatatactgttgggttagtgtcaatttctcaaactctcccaggctgccataatgcatgtctgacctaatttctatttctcttggaggaaaatacacacacacacacaccacagaagtgttgcattaagaatgctacatttcgaatagactttgcccttgcaattttaagctatgccatattcagattaattttgtgagtgatatctgcatatgtttctgtacagtgtgaaatgactgaccctgtagtatagtacgtgatagagttctacttgttaaagtaggttagatatagacactaatgtgtgtgatgatagtgtcctgtgtttcttagtgcaaatctgtagagtaaaaatgtccatagaacttttacttaaaaacaatcccatgctagagttgccattaagcagtgcaaaattaatcggctgtatggtagattcttgaccttaaatttaacaacaacaaccaaaatcagattttttttgtgagtcttactgacctaagaaacattgtttaaattgtttaaatggatctgcttgcagttatttgtgtacctgtttgttggggtgtgcattcttgtgtatgtgtgtgtgtgtgtgtgtgtgtgtgtgtgtgtgtgtgagagagagagagagagagagaatctcagtctcccagatagaattttataggcttaatgatgttttaatgttgcttggcatcccattgctctggcctcttctggcatttaccaatgacccttaacaaacacatctacccatgtgaccaaagtccactgacacaagaggccaggattcatacttgcacattaatgaaaagtcacaactggaaagcacagaaagagctgaaagcagcctccggtggcttcattttgtagatgagtccgttttgtaattctgcagaaagggggggatatgaacttcgcactgcagtgtcttcttgctccatcctaggtctgtctatatctctatctggctatgatcctttctagggttgatgaataccctttactgagtcaactattgctttaaagaattttttttgtaggtttatgtactcattttagttagcatctacctctctgggaaaatgaaaggagggttgacttagggatgagtatagatgttgaaagacaactatcaaaccatgtggtttgaatttttaaaattgtaaaacattggtgtccaaacctcccaccccacttgtatgtaaaggacagtgagtgttgtataaatagtaaactataagaagcatgaattttcatctttattaatgatcttgaaataaggaagagaatgcttaatatgttaagtagagccaagaatgctactaagaagcattgtctttggaaaaattttgtataatgacttggggcataagttgtgatgaaaaggcaacttggtttttggttccagtcatacttaatgatcagaaagctctaagatgttttctttaaaaatagaattaagtttaattttttgcatggcttacagattgggtcccttgaaggttaaaccatgtgatggtataacctgtgagatcttctagattggcactgttcaatagggctttctgtgatgatggaaatgctcgaaaacctgtgccgtctggtacggtagccaccaggcacattgacttttaggcagttaaaatggggttactacaagggaagaactggatttcaaattttatttaattttaattagcttaaatttaaatagccctatgtgtctagtggctgccatattgaacgatgcagttctgggtgatagcgcttggggatccagcatcaaggtattaatggagtaacagtgaggctaaggtgagagtttgtgggctagtgacatgcagttggcaaaaggcaaaacattcctttctgggcttaaaaagtatgtgatctcaagtatgacagtaaaaattcattgttgccctttggaactgttgcttatagattttaggccaaggaatgatcagtgaagcttaaagaatgctttattaagccccttttctgggatcattagctgcatgttaacctattgtccaaaaatagtagttagacagtacctgtaaaacgtttgacttgcaagctatgcatgatctgtactgtgaaattgtgtctagggtcttgtggccaaaaagtaaatgttacaggaaaaaaaaagcctaatgaaatccctgttcacttccagtatcctatccaaacttcattgctgtattagtaaggtgcaaatataagagcaagcatgttttgcagtgttcagactggttttgtttgcccttgaagttggccagcttgtcgttgtatttggtgtgggcatatgtgggcatcatttttcagatgccaaactaaaatgtaggtagtatttttagaatgagatttgacattgttttagtgtctttcttttttaagcaaaaatttcagttatccctgaaagagttgaagatttgaagctttgcacaaaagcactttttttaacagtaaaaaatactgcccatgaaatttaaagacttgaagtttactaaagctacaataattactttttagctaaataaaaggaagcagaaaattcagtttgagatatatttcctataaagaccagattcttactgataatctggtatttattccagtctagattttgattttaagagttcccatccctttatttgaaaacttatgttgtttcaaaattggttagtctgcttttcattgttttccaaatggaatatatacaaaatacatttacttcattttagcagaaatgggttgattttttttttctagaactcatcaatgtgcaagactttccttcttagcttgcctttaaaaatcatttaatttttttttttttgccaagatactaatctttctttagccttaataggaagatagaagttcaaaagttatcggtgcaaaaggagtgatacacaaaagacttcaatttctatcttttctcagaaaagtgatgctgcccaccagtcagcattttgtttccacataagaagtgtcaggtagtcagtctgtcatccctgacttagatagagaagctgttccttgacatttccatcattctcagtaaattgtcacctacaaggtaattcttaccaaaacagaaactattgagaataataagatagtcgagataattcagtagctgttttgaaagtagtagtctatttaaaaagcaacgatgttcagttgctggattttgttcaacatgagacacttatttatttatttatttatttatgagatggagttttgctcttggtgcccaggccagagtgcaatggcatgatctcagctcactgcaacctccgcctcccaggttcaagctattctcctgcctcagcctcctgagtagctgggattataggcatgcgcctccatgcccagctaattttgtattttttaaagtagagacggggtttctccatgttggtcaggctggtctccaacttctgacttcaggcgatccacccgcctcggcctcccaaagtgctgggattacaggcatgggccactgcacccagccaacatgaaacacttctaaaagataagtggaaattcaagccattgatttttctgacacaactgacttactacacacacacacacacacacaccacgatttagctgtaattggagttaaaattcagtaaaaaactgttattagtcatgttttccaatttgtgagttatacaatattggattagatgctaatttcttaactgttgctatgggctgcatacattatgtcaaactaactacctttgggagtgtctatataaacacttgaaacttttcaaatatatgaagaggtaggttctactgtatacattttattggaaagccattaatcattgaagaacttaagcaggtggggcatttaatttcttccaaataccttattttttggatctgctcaagtggttagggcgagtgcaccattattcccgaatccctgcaatttggttcccatttttctgcacaaattttcttgctcagtcgagccaatgactttttttttttttttttttttcaggattcactgcctggggtatcccactatatatatctcacctatgatgtagtggtgcttgaaatactcatctcattagctcgattttattattctaatctaaggttttttatattattcatactatgatatttttagggacaatcagtaatatttggggcagagtactgagggacctcttgaagtctgcaacagcatgcattttctttgtttttgtgggagtgcttccctgtagctgtctttgttctagaacactgctccaaatttatttccatgggatgtagggctagtagcccatgtgaaagtcttctgtaatctccttggggtgtgagttattgggttattctaacaggagttttccaaagggatggcccatttttaattcaacatttgctttttgaaaatccagaagtagacagttggatataatagtggtggaagagcatgggctgtaagcagaaggaaatagagatgacaaatgcctcttaaaggggatctagttgatacctctgttaaatagtgggagaacacagtagctggtaccttacactgtgctttaggaaaatcctatgaggatttcatttacaaatcctcataggattttctgggttgagggacaatgcaactattaagtagagggagagggagagggaaagggagacatgaagcactgggtctatgtgaagggacaggcagatatacccaaagagggagaaaatacttaataaaggaagagtatagctgcaaaacaagacatataggagctgaaggccagatatggcagaaaccagctggagaaagaagcacaggacaactaggacaacttagtcaagcacaatctgtcattccagtacggactaccaagttcaattcaggatgcttcagttgaagacatgtggggtaatgtgctcagctcatgagggtccaaggagtccccattttccctatcaccctatcctatgctcgtggtttggattgttagcacactaggcaatttcagagtccgctctagagttggttgccacgtcagtgcagacagactctagaatcctcttaaccatggaatgcaaggcctgttcctgtggatctatcctgacttgagtatgtcagtactgttgggaaaatgagttcaagaatatttcagtttatatatcctggttgccgtcatatattttttcatttcaccacttgtttgtgtttgcctcactcaacagtcatgggtgtagaagctggtttcagcttggggctgttacaaactccctacataagccatgtagctgcaatccagggttcctcccaccctacggctttagcggtgggttctctggccctcttgataacaaatactccagtctaatggctatattaatgctgctcagaggctattaactcaaatccttgatgtgtttcatttacaattatgtggattatttattttaggagctttttttttttttttttttttttttaagggccaaatagccctacagataaatgagctgctgggctgtgtagaaaatattgtccaaatgttgccaaatattgacttcgtaaaggggatatcaagctgctgtttataaatctgaatgtcttaaaagcattcttgcttgctctctctgttatagatggtgtcttagccagtcctgagttttccaatgaacccaattttaatatatggtatttttgtatgccaaactggtgtcttgtcctttgtatatgtggtaatgttgattttatgactaccgtaaaaacacatttgctatgattaaagttcataaaatgatttcaaataga

SEQ ID NO: 5702 - DNA, 1916 bp, Homo sapiens
aggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcagagggactgggtcttcacttcttgggctaataaaattgtttctttgtggactaag

SEQ ID NO: 5703 - DNA, 3812 bp, Homo sapiens
agttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaagatgaaaaacatttatctccagtcagcacacttgatgttcacagttagacatttaaacaagagctcatcctttcgtagtagatataaaagtaatttgtaaagggaagattgttttaggaacctgggcgatgctgcaaacacagagtagcctgatgcatttctgaggaaggtgaatcttcgtgtctttgagcatcaagccaataggaaggtactgggaacggtatttacatttgacaaaagaaattactggttagctatagcaacagattggacaaattttgttagttttctgttgtcagaaatttttataatactgtctcaggatggcagcacacagctcagattcatgtcttgagccaaacaagtgaatgtatctgagaagactcagtaccacatggtactgggagatcttactcacttcagctggcgttgctcattagtgaatgtatgacagcaggatgtgaggggatgcccaggagtcagtgttagcattgtcatctgagatcactgctattaatatcatccattaatttattagtgagcttcactatatgcagactgggagataaggagaaaatctgtcacattctctctagctaatcagatcagctaccaattaatgagattctgaatgaaatatcaatatgtgtttttctaatttggacctaggacagagctgttgcttgtcatagagaaaaacaataatgcttaaacatagcacattataattaaagcaggtttctcacatacttttcattttatcctttggataattttgtgaggaacgcaggacaccaacttccctttcatagatacaatccccatgctattgatgaaagtgtttttgaatgaagtcatacaacaaataactgatcaaagtggcattacaccaaaatttcttagtaggactcctgcatagaatgtttagatagacgtgaaagttgttaagaggaacagcaagagagaaactggttctttggaagtctttcgtgctacattatacctccatcagagtaagacagcttaggcactcctaagaggaaaggtctgtggagatgacatgaatccgaattctacacttccaaatcaaataggtaaaagggtggcatacatcacagaaaaacatttcagctgcagtcaccaacttgaaaagcgagtgagtaggagtttgtcacactgccatgtaccagactggaaatgcatttcctaccaattacacatttggtgtgggggaatggtgatgtcattttttgacaggattttattttgtgtgcatgcattctgctccaagtgtcacaattctggttacaataattataatatttggagttactactaagactttcctgaaagaggtgtattgtaccaaattttgtaacataaaaaaatactaaatgatcttaaagcttcctaaattgtgaaaagggtatgtgctaacatctcagaactttagacctgcttgttgtcatctttaccgatctctgatgataaatgcagaagggatctgagagtttttaaagcaagtagagtcaatcagagttttgaacatcatagtaatacttccgtgattcagagttagatcatataaatcaaagtaacaatttggattttttttaaacaacaatatcataactgtcataaaacagatggtccaaccccaggagcagataataacttgggcagctctgtggggaacaagacggggaaaacaactgttctaactgcccactagaacagtggtttcaactactacaattctcagtgtttgagaggtacaagggaagaaaggactatgtggatcccttgtggctatgcagatacctacctcacagagttgttgtagaagactggtggtttggttcaaaccttgtgattaaagagtttgtcaagcattttattcttttgaataaaagcaacatatctaaaacatttt

SEQ ID NO: 5704 - DNA, 1866 bp, Homo sapiens
gacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacgggttcatcagagaagagcagccgtgcaagtgagcagacccatcaagaggctgttgcatgcctggacacacagaactctcctgcctgtacagtcggatgcaggtcagggcctcagcatataccccatgaccgaatgctcccttcagcctcaccacgtttatgcttcacgttactagactgtgtttccatcctttggttctcaggttaaatgttccctcctcactcagactacccaaaagtaggcagtgcaaaagtagtgcaaaagtaggcagtgaccctcccctccccttaccccagggcactctgaggcattcagacatctcagcacagcatcatcatattgacatttccattgtctgtctgcttctcactagaacacaagctctatgaaaacagagacaatgttagttttgtccacccagatattcacagatgtaccattatgcctgccaccacagtagtgctcaacacattaaagattaataaataaagcaagggaaagacaggaaagggcagaagacaaggaaagatcacttcttactcagtcatggctgccgcccaggtctaagccaccctcacttctcacctaaaggatcacagcgaccttccaggcagtctcccaggcaccaagtgcctggctccctacatgcaacgcagcccgatgatcatctcaagtgtgactctgctggaaagcctgctctccctttcccacagagtaaaggtaaagtcctcacgccagcctgcaaggccccatgtgaccttggttgctcatttcctctctaacctcatctcacatttgtccccacagctcactctgctccagccatccagccctccttgctgtcctttgagcaggctgaagacgcccagcctcaggagctctgccctggccagtccctctgactgctaggctcctccgccgggcatcctcacagccaactctcaccaactccagatcttcgcacaatagccatttcctctgttaggcctgtcctgtccaccataaggaaacttgcaactccctcagcccacagagcacctctcaccggctaacatactctgtggtcacgtgtttgctatctgcctccctaatgtctttgagaacattagctccctgagggcagaaatctccttcactgacatatcccaagcccccagaactatgcgtgcagcatagtcagtaactatttgttgaatcaatgaatgagaaaacaatatcagggaactctaagttgaaatacactttctcagttcacaatgttatccattctgacctttatcagacacaggcacagaggacctcagagatattcccagcagtctcaatatccatggtaatgctaataaactactattctggca

SEQ ID NO: 5705 - DNA, 195 bp, Homo sapiens
ggcaccgtcgcccgcagcgctcgccccacgggccgcgcgtggagggtcccgacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcag

SEQ ID NO: 5706 - DNA, 3880 bp, Homo sapiens
ttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaagatgaaaaacatttatctccagtcagcacacttgatgttcacagttagacatttaaacaagagctcatcctttcgtagtagatataaaagtaatttgtaaagggaagattgttttaggaacctgggcgatgctgcaaacacagagtagcctgatgcatttctgaggaaggtgaatcttcgtgtctttgagcatcaagccaataggaaggtactgggaacggtatttacatttgacaaaagaaattactggttagctatagcaacagattggacaaattttgttagttttctgttgtcagaaatttttataatactgtctcaggatggcagcacacagctcagattcatgtcttgagccaaacaagtgaatgtatctgagaagactcagtaccacatggtactgggagatcttactcacttcagctggcgttgctcattagtgaatgtatgacagcaggatgtgaggggatgcccaggagtcagtgttagcattgtcatctgagatcactgctattaatatcatccattaatttattagtgagcttcactatatgcagactgggagataaggagaaaatctgtcacattctctctagctaatcagatcagctaccaattaatgagattctgaatgaaatatcaatatgtgtttttctaatttggacctaggacagagctgttgcttgtcatagagaaaaacaataatgcttaaacatagcacattataattaaagcaggtttctcacatacttttcattttatcctttggataattttgtgaggaacgcaggacaccaacttccctttcatagatacaatccccatgctattgatgaaagtgtttttgaatgaagtcatacaacaaataactgatcaaagtggcattacaccaaaatttcttagtaggactcctgcatagaatgtttagatagacgtgaaagttgttaagaggaacagcaagagagaaactggttctttggaagtctttcgtgctacattatacctccatcagagtaagacagcttaggcactcctaagaggaaaggtctgtggagatgacatgaatccgaattctacacttccaaatcaaataggtaaaagggtggcatacatcacagaaaaacatttcagctgcagtcaccaacttgaaaagcgagtgagtaggagtttgtcacactgccatgtaccagactggaaatgcatttcctaccaattacacatttggtgtgggggaatggtgatgtcattttttgacaggattttattttgtgtgcatgcattctgctccaagtgtcacaattctggttacaataattataatatttggagttactactaagactttcctgaaagaggtgtattgtaccaaattttgtaacataaaaaaatactaaatgatcttaaagcttcctaaattgtgaaaagggtatgtgctaacatctcagaactttagacctgcttgttgtcatctttaccgatctctgatgataaatgcagaagggatctgagagtttttaaagcaagtagagtcaatcagagttttgaacatcatagtaatacttccgtgattcagagttagatcatataaatcaaagtaacaatttggattttttttaaacaacaatatcataactgtcataaaacagatggtccaaccccaggagcagataataacttgggcagctctgtggggaacaagacggggaaaacaactgttctaactgcccactagaacagtggtttcaactactacaattctcagtgtttgagaggtacaagggaagaaaggactatgtggatcccttgtggctatgcagatacctacctcacagagttgttgtagaagactggtggtttggttcaaaccttgtgattaaagagtttgtcaagcattttattcttttgaataaaagcaacatatctaaaaca

SEQ ID NO: 5707 - DNA, 580 bp, Homo sapiens
aaattagaaaggggacgtctagtgggttgcccgggaggggtggcgggagcggtcctggaaataatctgtcctctgtcgccgggaactggcgaggtagttccttcgcggtggagaggtgtcttataagactttgacacttcctgttttgtctgaaaaaaatgtgaattacctgtgatatttggactccagtgtggctgggctatctcccctcatacctatagaattagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggc

SEQ ID NO: 5708 - DNA, 4116 bp, Homo sapiens
agttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagaggtacgtccggcgcgcggcggccacgcccaccctatcggggcccgcggagccgcggacggcggggtctggccttcttggggtagctctggccgccgaggctctgcggggcggcgggagtcgccgcctccttccccccgggcccctccctcgtctggaagccccagaatcgccccgcggctgtccggagtcgccggcgacggtggaggggccgacgcggagagcggctctagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaagatgaaaaacatttatctccagtcagcacacttgatgttcacagttagacatttaaacaagagctcatcctttcgtagtagatataaaagtaatttgtaaagggaagattgttttaggaacctgggcgatgctgcaaacacagagtagcctgatgcatttctgaggaaggtgaatcttcgtgtctttgagcatcaagccaataggaaggtactgggaacggtatttacatttgacaaaagaaattactggttagctatagcaacagattggacaaattttgttagttttctgttgtcagaaatttttataatactgtctcaggatggcagcacacagctcagattcatgtcttgagccaaacaagtgaatgtatctgagaagactcagtaccacatggtactgggagatcttactcacttcagctggcgttgctcattagtgaatgtatgacagcaggatgtgaggggatgcccaggagtcagtgttagcattgtcatctgagatcactgctattaatatcatccattaatttattagtgagcttcactatatgcagactgggagataaggagaaaatctgtcacattctctctagctaatcagatcagctaccaattaatgagattctgaatgaaatatcaatatgtgtttttctaatttggacctaggacagagctgttgcttgtcatagagaaaaacaataatgcttaaacatagcacattataattaaagcaggtttctcacatacttttcattttatcctttggataattttgtgaggaacgcaggacaccaacttccctttcatagatacaatccccatgctattgatgaaagtgtttttgaatgaagtcatacaacaaataactgatcaaagtggcattacaccaaaatttcttagtaggactcctgcatagaatgtttagatagacgtgaaagttgttaagaggaacagcaagagagaaactggttctttggaagtctttcgtgctacattatacctccatcagagtaagacagcttaggcactcctaagaggaaaggtctgtggagatgacatgaatccgaattctacacttccaaatcaaataggtaaaagggtggcatacatcacagaaaaacatttcagctgcagtcaccaacttgaaaagcgagtgagtaggagtttgtcacactgccatgtaccagactggaaatgcatttcctaccaattacacatttggtgtgggggaatggtgatgtcattttttgacaggattttattttgtgtgcatgcattctgctccaagtgtcacaattctggttacaataattataatatttggagttactactaagactttcctgaaagaggtgtattgtaccaaattttgtaacataaaaaaatactaaatgatcttaaagcttcctaaattgtgaaaagggtatgtgctaacatctcagaactttagacctgcttgttgtcatctttaccgatctctgatgataaatgcagaagggatctgagagtttttaaagcaagtagagtcaatcagagttttgaacatcatagtaatacttccgtgattcagagttagatcatataaatcaaagtaacaatttggattttttttaaacaacaatatcataactgtcataaaacagatggtccaaccccaggagcagataataacttgggcagctctgtggggaacaagacggggaaaacaactgttctaactgcccactagaacagtggtttcaactactacaattctcagtgtttgagaggtacaagggaagaaaggactatgtggatcccttgtggctatgcagatacctacctcacagagttgttgtagaagactggtggtttggttcaaaccttgtgattaaagagtttgtcaagcattttattcttttgaataaaagcaacatatctaaaacatttt

SEQ ID NO: 5709 - DNA, 1338 bp, Homo sapiens
ggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactat

SEQ ID NO: 5710 - DNA, 3203 bp, Homo sapiens
acaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctctctcatacaaagctttctgcagaagacacatggaacctgcagcaggagaggatgtacaagatgcaccggggccacgattccatgcacgtggaaatgatcttgatcttcctctgcgttctggtcattgcccagatagtgctggttcagtggagacagaggcatggccgatcctacaatattggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtgtatccttttcaaaggaaattgtttgggcttcatcaagcctccttctttcctccttctcctcctcctcctcctgtccccatctcctccatcttgcttaccttccatgcccaaaccccagtcctttatcctccagcccagtcgagtcttcctgtttgtccctgctgaataatgaactgctaattaaggtgaacctcctcctccagtaatttcctttctaaagaggactgttaatgccacatagacaggaaggcagtatctgagcagggtgctggcaggggaaattggttgaagtcataagtgagcagatagccaacaaagatcagggaaagaaggggtttggaggtgagaaaaagagtgaagtatcaggtgcaggggggaacttaagactatccaagtggagcccaaggtctgaatcttagcagatcaagaaatacaaagagtgctttgcctagaaataatcctaggaacctacctgtggcaacagtagtcttgggggcagccaagggaggaaaccaagccttcttctcagcttcagtctttagaagaagatacagccacaggcagcaagacaccttggattacaaaagcagggaccaaaatttggacatttgttcttggaccatgggctcctccaccaatgggttctatcccaaatagctatccattggctgagggatcttcatatgataggtaccagacagcctgagcctggaaaccagcattctatgtgaactccagtaaccattaaggaaagcctcaatgtgctgaaaaatgctggcatcgagacccctgaacaaatcaacctgtgttgcctgaacatgtatggacactacttttgctatggataccaaagttaggcttaggttggccaatcatcagtattttaattcttcctaaatacaaaaaagggtatcatttatctttattttatagtacagtatcaatttaataatgtcatcgctatgtacccagttagttcaaagctctggcattatgagatggttaaaccatctgtcttttgcctaaagcccacttaatttagtcagtcatacctcggtgtccagtacctatgattcaattctgtttaatctggacagtttccacttattcaatcctgaaagtaaaaccaggaccaaatgcatctcaaaagtaataggagcctttactccaatacataagccttaaaatcttaagggaagaaacacaaagataccccatatggatttctgtagtggttttttcagtgtgatacctttcccaaaaaactcattctttgtagcaattttccaagtctggccctagttttaaatatgatttatttttcaaatgttggaacagagccccttctgccatttgcaaatggaaatgttttctctctccacctttaaaagcccttagggattgttgtacatgtgtgcatatataatctaaaatgtagtcacctttaaatttgcttttcagggagtattattaatggcccattttagcatgagtcatattagtgagaaatgggcaaatatgagtcatattaacaaggatgggttatctgagtcttgctctgcagaagttctgccagtgtgcaagtttttcagcattgagattttgaaaatgaaaaagaacattagagagaatgtggacatttctgtgctgactcaatggcccctgaattctatacctctgtagaagatggggctgtattccagcccttttgaatgaaaggctgtttgagttttggttcaaaatcttcgttataatacaccactttattttaaagcatattgcaaaaatgaccccaattccaagaacataaaataatggaaactcctggttacattgaaatttaatactgaggagttatatacatggccttgacttgctacacctccaagctcctccatttgttagggagggaacttctacatcgttgctgttcacctgggtgtgtagcaggccagtcagaagatcatgtgatcttggcccagaaagtcacattgggagcagcgattgtagaaataaacaaatcagtaggatggatttcattatagttcattttgcccaaatccatagtatcagggaacatggaaatatatattcccaaaaataatcagttttgaaagagtcattcaaatgttcattcaataaatatttcttaggcatggcttaaggtgctgaggacactgaaatgaatgagacatagtcctacaggtaacacatggtctaggagaaacatgtaagtaccaaaagtcctgctacactagagtaagtccctggtgctgtgagaacacatagggttcactcaagtttggggacaaagggtcagactttctggaccaggagacgtatacaaatggatctgtaaatgcctagagtttgagaagttaagtttagtaggtatatattctattaaaaataattggctccttatcagtacttttaaaagtcaag

SEQ ID NO: 5711 - DNA, 1604 bp, Homo sapiens
ccagtcctgccgcccggtaacaaaaccggggttcccgccacacgcacccggtagggctcaagacgctttatcggcgacaatggctggctgaatgggaggcctgaggttctgaaggaaccggggtgctggcgaccgggacctcgaggccgctgctggggaggacgctggccagcgtgcagggggcggaggcggggcgtgccgggaggctcccatctcccgccccgcacaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctctctcatacaaagctttctgcagaagacacatggaacctgcagcaggagaggatgtacaagatgcaccggggccacgattccatgcacgtggaaatgatcttgatcttcctctgcgttctggtcattgcccagatagtgctggttcagtggagacagaggcatggccgatcctacaatctggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgattggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtctttcatgaattctgcatccgaggttggtgtatcgttgggaaaaagcagacttgcccttactgcaaagagaaagttgatttgaagaggatgatcagtaatccctgggagcgcacacattttctgtatggacaaatcctggattggcttcgttatttggtggcctggcaacctgtggtgataggaatagttcaaggcattatctattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaataaagcatgttttttcatctttcccattacagctgtttcttaactcatgcacatgtcacatttg

SEQ ID NO: 5712 - DNA, 1727 bp, Homo sapiens
aaccggcatcgccgccgccggagccgcagcgagtcctcagagcctggctgctggcggccgggagcgccgggacggggcgcgaagccggaggctccgggacgtggatacagatgaaaagaagcaaagaattgataactaaaaatcatagtcaagaggaaacaagtattcttcgttgttggaaatgtagaaaatgtatagcaagctctggttgttttatggagtatcttgagaatcaagtgattaaggataaagatgattcagttgatgctcaaaatatttgtcatgtgtggcacatgaatgtagaagcccttccagaatggataagctgcctaatccaaaaagcccagtggacagttggaaaactgaattgtcctttctgtggggcccgtttagggggctttaattttgtcagcactccaaaatgttcctgtggccagcttgcagctgtacatctctccaagagccggactgattatcagccaacacaggcaggcagactaatgagaccatcagtgaaatacttgtcacatcctagagttcagtcaggttgtgacaaggaagctctgctgacaggtggtggctctgaaaacagaaatcacaggcttttaaacatggcccgaaataataatgaccctggaagattaacagaagcactctgcctggaggtgcgaccaacatattttgagatgaagaacgaaaaactgctgtccaaagcatcagaaccaaaataccagctttttgttccccagcttgtgactggcagatgcgctacaagagcttttcatagaaaatcacatagtttggatctgaacatcagtgagaaactgactttattacccactttatatgaaatacatagtaagactactgcctattccagactaaatgaaacacagcctattgacctttcaggcttgcctttacaatctagtaaaaatagctattcctttcagaatccatccagttttgatcctagtatgctgctgcaaagattttcagtggccccccatgagacccagacacaaagaggaggagaatttcagtgtggtctagaagctgcttcagtgtattctgaccatactaatactaacaatctgactttcctgatggacctgccctcagctggcaggagcatgccggaggcctcagaccaggaagagcacctctcccctctggacttcctgcactcagccaatttttcattgggcagcattaatcagaggcttaataagagagaaaggagcaagttgaagaatctaagaaggaaacaacgaaggcgtgaaagatggctacagaagcagggtaaatactcaggagtgggattgctggatcatatggtaagtatatatttacttatatgagaaattgtcaaattgttttccagaatggctgtaccattttgcattccaagcagcaaagacttccattttctgtgcgtccttgaaagcaagcactggtattctcagtgttttaaaattttagtcattcaaatacatagacagttgtatcacatcatgactttaatttgcttttccttaaggatgctgaacatatgtgcttattttacatttgtatatattctttagttaagtgtcttcaaatcttttgggctggtgtggcagcttatgtctataatcccagcacttttgagaggccaaggcaggaggattgcttgagttcaggagttcaagaccagcctgggcaacatagcaaaaccttatctctac

SEQ ID NO: 5713 - DNA, 767 bp, Homo sapiens
aaccggcatcgccgccgccggagccgcagcgagtcctcagagcctggctgctggcggccgggagcgccgggacggggcgcgaagccggaggctccgggacgtggatacagatgaaaagaagcaaagaattgataactaaaaatcatagtcaagaggaaacaagtattcttcgttgttggaaatgtagaaaatgtatagcaagctctggttgttttatggagtatcttgagaatcaagtgattaaggataaagatgattcagttgatgctcaaaatatttgtcatgtgtggcacatgaatgtagaagcccttccagaatggataagctgcctaatccaaaaaggtaaatactcaggagtgggattgctggatcatatggtaagtatatatttacttatatgagaaattgtcaaattgttttccagaatggctgtaccattttgcattccaagcagcaaagacttccattttctgtgcgtccttgaaagcaagcactggtattctcagtgttttaaaattttagtcattcaaatacatagacagttgtatcacatcatgactttaatttgcttttccttaaggatgctgaacatatgtgcttattttacatttgtatatattctttagttaagtgtcttcaaatcttttgggctggtgtggcagcttatgtctataatcccagcacttttgagaggccaaggcaggaggattgcttgagttcaggagttcaagaccagcctgggcaacatagcaaaaccttatctctac

SEQ ID NO: 5714 - DNA, 4906 bp, Homo sapiens
agagcctggctgctggcggccgggagcgccgggacggggcgcgaagccggaggctccgggacgtggatacagatgaaaagaagcaaagaattgataactaaaaatcatagtcaagaggaaacaagtattcttcgttgttggaaatgtagaaaatgtatagcaagctctggttgttttatggagtatcttgagaatcaagtgattaaggataaagatgattcagttgatgctcaaaatatttgtcatgtgtggcacatgaatgtagaagcccttccagaatggataagctgcctaatccaaaaagcccagtggacagttggaaaactgaattgtcctttctgtggggcccgtttagggggctttaattttgtcagcactccaaaatgttcctgtggccagcttgcagctgtacatctctccaagagccggactgattatcagccaacacaggcaggcagactaatgagaccatcagtgaaatacttgtcacatcctagagttcagtcaggttgtgacaaggaagctctgctgacaggtggtggctctgaaaacagaaatcacaggcttttaaacatggcccgaaataataatgaccctggaagattaacagaagcactctgcctggaggtgcgaccaacatattttgagatgaagaacgaaaaactgctgtccaaagcatcagaaccaaaataccagctttttgttccccagcttgtgactggcagatgcgctacaagagcttttcatagaaaatcacatagtttggatctgaacatcagtgagaaactgactttattacccactttatatgaaatacatagtaagactactgcctattccagactaaatgaaacacagcctattgacctttcaggcttgcctttacaatctagtaaaaatagctattcctttcagaatccatccagttttgatcctagtatgctgctgcaaagattttcagtggccccccatgagacccagacacaaagaggaggagaatttcagtgtggtctagaagctgcttcagtgtattctgaccatactaatactaacaatctgactttcctgatggacctgccctcagctggcaggagcatgccggaggcctcagaccaggaagagcacctctcccctctggacttcctgcactcagccaatttttcattgggcagcattaatcagaggcttaataagagagaaaggagcaagttgaagaatctaagaaggaaacaacgaaggcgtgaaagatggctacagaagcagggtaaatactcaggagtgggattgctggatcatatgactttgaataatgagatgagtacagatgaagacaatgaatatgcagaagaaaaggatagctacatctgtgcagtgtgtctggacgtttatttcaacccttatatgtgttacccttgccatcacatcttctgtgagccctgcttacggactctggccaaagacaatccttcaagcactccatgcccattgtgtcggacaattatttctagagtctttttccaaacagaattgaacaatgccacaaaaactttctttactaaagaatatttgaaaataaaacaaagctttcagaaatccaactctgcaaaatggcccctaccaagctgcagaaaagcatttcatctttttggaggtttccgcagacatgcagctccagttacaagaaggcagttcccacacggtgcacacaggatggattacctgcactttgaggatgatagccgtggatggtggtttgacatggatatggtgatcatatatatttattcagtgaactgggtcattggattcattgttttctgctttctttgctattttttctttccgttttaggaatttcataccttactacaattgaccaatcataaatgatgtaaataacaattgcttaaacatttttaaatgtgctttgaagtttttttaatgttgcattatacaaattgttgatgtttatagaaagcctgagaataatgaatttatttattaatgtttttcatgtaacaaactaaactttattcaagagctaacctacccagcacttagcaacaatgcactattaatttcatagttgttcttgggttaggatttggggctctgattttataatatcactttaatacttattttgattgtaaaaaactgaagttttctctccacttaaaaatagtaaaaatacaaaaagaaatgataatctaggtagatattatctttactgataaaatatttagtcaatcaccacttattctcaggcaaattatatgtattaaagataaaccatattctctgggaactaatctagcagggtatattcagttttggtttctaattgtcactacttatatccctttctagtaccaagaaaactgactattctttttgtacagatctaattagtacaacattttaaattattataaacagaatactaaatacaaatcatgagactaatccctaccaataaacactttagctagctataaacactttccagattgaaggattaatcaccagaagacatgaaaaatttaccgacttttagtagtctaaaagagcaatgcatggtccaaaatgtaatttagtgattcatttaagtaggagatggtcaaatatattgtaaatgtgcaataaagagtggcttttaatttttttaatgtctgaataaagtattgttataaataggcttatcgattttagaaagaaaacctgacatttttaattacagtaatcattaatttttttcattattaaaatttaaaaataagagaactgaatcattagaacatggaattggggcaggtaacccaattcaaaaaaggaaaaactggagcagagacttaagcttatttattcagttattctggtggtctttgtgaaacctgggacaaagtttttattatgaattactaatccagtattactacactatgatgtcatatatctggtaattcaataagcaaacttttacataaaataggtgactctctcgtggcactaaaaatactaccactatccaaaaacattgggatcaactgggctttaacagtttcaatctatgaaaagccaaaatttaagctaattgctactaactgtatttcaataaaagcacttgactgttggtatgtgatgttctaagaaaactagaagaatggtactgatttctattctaatgctgttcttattattgtgttttaaattatatctattacagaaaatagtatacactagacatcaaatccagaaatcagaacactaagtacaatttagaaacacagataaatttatacttataaatggatatttataattactaattgctcaaagtaaacataagggaaaatatcagctctcttaaaatatatagcaagattgaaaacacacatatgaggagttgcattattttaagaactttaaattgcagccatttcctaggcaacttctggtttatacactctagaaaatatatcttgattcattcctaaatcacaataaaggttttaattatgtataaactaaataagtattattatagatacagatctctcataggaacaaagttgattcccaatatatatttgttaggtcagtgatacatatcagtttatagatctcagtctactaaatatttatgatacccttaaataaacatgaacctttaaatgaagaaagcataatctggaaaagcattcaaaatggattgagtatatttatcttgactaataacttgatctgaaaattatagaatattaaaagaagtaaattcataaaattataaattactaatctttaaaatattcttaaattttgtaaaagtggagataaaaactgctaaatattaagaagtatagcatttcctagatctaccagcttataagaagccagataaaatctcagatggaaagaaaccagtttcttctggtatgtagcacacagtagccattcaaaataaaatacatggatgagctttagagtaaaacaaaaaattataatgctcttcctaagcatctctcacagtaaaaactcactgtccaataaagagccaaagaaaggaaaagaagaaaaatgttaaagttaatgaagcatagtacttgtcccaagtaatattatttaataagcttaattttatgagttatcattatcaataatttctatttctaccaagcttaattatggtaaaggttaattttaaacatgttcacacattcttttttaaaaaaatgccctaattgaggtatatttctgaatagtttcagcaggttattttttaattttaaaaaagcaaattcacaaacctagacccatttattttatactcagcagaagacagggaaatttaaattagacaaagttgaaaaagaatcagaatttatattttacaaagcttctaccactctgaatcaacaaaatcaggaatggaaaaaaaaatttctgtatctgctgaattattaatgccactatagtattatatgctaaatatgaaagcagtgctgccatcagtttcacttctgccttggaatcttgctcctaagttagctctgtggcataacaaaattccagttaataaaattttcatttaaatgtcttttgtatggctaaatgaatatacagattcttaaacatctaatttttatatggatttctcaaagaatgccttacagaagagcattctctgattaaatgcaattacagttggagtctttgattcttcacagaattctgtagttgaagccagaaaacactgtcatttaggaaagtgttcctaaaggtttgaatgctttaacatgctcaactcttacttcttgaagtgtttgattgtcagtaaattttcgaagaacattaaagttctaccaatgtagaagcatgaggaataaaagatggtctggatcaagaa

SEQ ID NO: 5715 - DNA, 421 bp, Homo sapiens
tcgcacctgaggctctcggagcggcctcggggcgcgcccacctggaggttggaattacacagggtcgaaaaagctgagtcctggaggcgaggcgctgtagatgaaaagaagcaaagaattgataactaaaaatcatagtcaagaggaaacaagtattcttcgttgttggaaatgtagaaaatgtatagcaagctctggttgttttatggagtatcttgagaatcaagtgattaaggataaagatgattcagttgatgctcaaaatatttgtcatgtgtggcacatgaatgtagaagcccttccagaatggataagctgcctaatccaaaaagcccagtggacagttggaaaactgaattgtcctttctgtggggcccgtttagggggctttaattttgtcagcactccaaaatgttcctgt

SEQ ID NO: 5716 - DNA, 826 bp, Homo sapiens
agacaaagccgcccgcccgccagcccgctagctcctcgcgcgagctcctcctccacgggaacctccctcccctcccaggcgccgccgcagccggagcggctcccgggccctgggccgccgccggccagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcacca

SEQ ID NO: 5717 - DNA, 633 bp, Homo sapiens
gtctccctccgggcaccacgggggccgccgtcctggcaccaacttgaggggctgtgcggcggagggcggctgcggagcgcccgcgcgggctgcacctgctcagggagctgcccctctgttgttgttgttattttccttcttggcgtgccatcgaggcttttgggggaaaaaaagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccga

SEQ ID NO: 5718 - DNA, 557 bp, Homo sapiens
aacctccctcccctcccaggcgccgccgcagccggagcggctcccgggccctgggccgccgccggccagactgcctgcaagggatggtcatactcctggctgcacttccagagtcttgaagaagaaagcagatgtggatacctaaatatagggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcag

SEQ ID NO: 5719 - DNA, 3706 bp, Homo sapiens
gacgcagggtcggcggctcagcgccgtagagacaaagccgcccgcccgccagcccgctagctcctcgcgcgagctcctcctccacgggaacctccctcccctcccaggcgccgccgcagccggagcggctcccgggccctgggccgccgccggccaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaatttagaagtttgatttctctgacttatggttaaaattcagttatgactttgcacctctgttagctttagataacggcaaacatgaacattcagaaacgttggttcagctaatgcctttatcatgcccgtgaagacttcagaactttccaacaaaggggacctaacccatcacacttttaaaaggccttcatagtttttttattttattttattttattttattttattttattttatttatttattttaaagcaggggagaaaaattaggggagatgaaataaaaatatcgtcttta

SEQ ID NO: 5720 - DNA, 646 bp, Homo sapiens
gtgcatgctgcggcagttgcaacaggagaaccgagtaccagttgctcaacactttatcactttgcattgctctttctcctcccttaagtgaatttccattttgagggtacagctccacaggagaaaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatc

SEQ ID NO: 5721 - DNA, 3274 bp, Homo sapiens
gtctccctccgggcaccacgggggccgccgtcctggcaccaacttgaggggctgtgcggcggagggcggctgcggagcgcccgcgcgggctgcacctgctcagggagctgcccctctgttgttgttgttattttccttcttggcgtgccatcgaggcttttgggggaaaaaaagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaattt

SEQ ID NO: 5722 - DNA, 3382 bp, Homo sapiens
gtgcatgctgcggcagttgcaacaggagaaccgagtaccagttgctcaacactttatcactttgcattgctctttctcctcccttaagtgaatttccattttgagggtacagctccacaggagaaaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaattt

SEQ ID NO: 5723 - DNA, 3495 bp, Homo sapiens
gacgcagggtcggcggctcagcgccgtagagacaaagccgcccgcccgccagcccgctagctcctcgcgcgagctcctcctccacgggaacctccctcccctcccaggcgccgccgcagccggagcggctcccgggccctgggccgccgccggccagactgcctgcaagggatggtcatactcctggctgcacttccagagtcttgaagaagaaagcagatgtggatacctaaatatagggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaattt

SEQ ID NO: 5724 - DNA, 3165 bp, Homo sapiens
gtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttatggaaacaaagatcttgaggaagatgagggaagccctcccctcttcacagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacatta

SEQ ID NO: 5725 - DNA, 994 bp, Homo sapiens
atgtgactggagtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacag

SEQ ID NO: 5726 - DNA, 3315 bp, Homo sapiens
ggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagaggggtgaggaacattctaggagaagcttctacaaatgagctgatggctttagaagtttccttcttagccttacaatttttctccttgattataaaagtaaaggaaaacttgtaaaatacagaaaggaaaagagggggaaaaaaatcacttataaccacaccaatccagaggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttatggaaacaaagatcttgaggaagatgagggaagccctcccctcttcacagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacatta

SEQ ID NO: 5727 - DNA, 2737 bp, Homo sapiens
ggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatgagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttatggaaacaaagatcttgaggaagatgagggaagccctcccctcttcacagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacatta

SEQ ID NO: 5728 - DNA, 2946 bp, Homo sapiens
agtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttatggaaacaaagatcttgaggaagatgagggaagccctcccctcttcacagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacatt

SEQ ID NO: 5729 - DNA, 4285 bp, Homo sapiens
gggggccgcagtcggggccacccgggtgcagcggggcggctcctgcgcgggcgcggaacgaacgtgcgcaagggaacagccgcgtccagagccgcccgcagcgggcccggtgggcgtgacgccatgacgcacagcacgcgggcggcgcgctggggcggggcggccgggggcgggaggaagaagtgggaggaggaggaggggaaagcgggggctgcgggagggggaggtggtagttgcggcgctggttcccgggagcagccgtcgagccacaactgcggaggaggagttcgggaaagcggccgtcgggactcctcccctccgtcgtctccgccccggttgagaggcgcctcggcgcatcggagggaccctcccccgcgcttcctcaggctgctgtcgccgctgctgggagatgggcctactcgcccgccaccctgcgctgccgccgctctgaggagttaaagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaa

SEQ ID NO: 5730 - DNA, 432 bp, Homo sapiens
gacacattctcccctcaagccccagtgggagcacggcccagctggattttggacttctggcctccagaactaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatg

SEQ ID NO: 5731 - DNA, 4330 bp, Homo sapiens
atagtcaccagaagctggaagagtcaaaggacacattctcccctcaagccccagtgggagcacggcccagctggattttggacttctggcctccagaactagacagggcctcactgtgtcacccagggtggaatacagtggtgtgatcatagctcactgcagcctggaattcctgggctcaagcaaccctgccacctcagccttccaagtagctaggactacagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgtactgctgc

SEQ ID NO: 5732 - DNA, 817 bp, Homo sapiens
gcctgtctactgccgagggcatttgagtgtgggacccatgccctgcatttcttcgctaccccacagcttctgctcatgaatccagctcaaatgtcagaagaattgacgttagtttgagagaccaaactaagttacagcctctttggtttctgttactctggctggtcttgaactcctggactcaagtgatccaaccacctctgcttctcaaagtgctaggactacagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggataga

SEQ ID NO: 5733 - DNA, 612 bp, Homo sapiens
ctcttctctcattggcactgcctgtctactgccgagggcatttgagtgtgggacccatgccctgcatttcttcgctaccccacagcttctgctcatgaatccagctcaaatgtcagaagaattgacgttagtttgagagaccaaactaagttacagcctctttggtttctgttactctgaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacct

SEQ ID NO: 5734 - DNA, 792 bp, Homo sapiens
atgacgggccgaggcggcgctcccctcgagctgtctcctgcccctaaagcgggggagacccaagggcggttgccgcggggaggcggcgggggcggaacgcattcctgacgggtgaaatcggctctaacgggaccgatttccgggcctcgctgcaaatttggagccgggacatcgccccgcaagccgtgctgcctggggccttagggaggggagctgtgttcggaggaagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtgga

SEQ ID NO: 5735 - DNA, 547 bp, Homo sapiens
actcgcccgccaccctgcgctgccgccgctctgaggagttaaaggtagcctcaaaatcaagtgacaagtgtctttgtaagggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcactgtgtcacccagggtggaatacagtggtgtgatcatagctcactgcagcctggaattcctgggctcaagcaaccctgccacctcagccttccaagtagctaggactacagaacatccatgatagcagtcttctgtaaatcgaacttttcaagaattctctgaaggaaccaagtaggatattcttacatcatgacttaatgtgaatgcaagaacaagaaataggttttatctctaaatataatgaagg

SEQ ID NO: 5736 - DNA, 2334 bp, Homo sapiens
atgggctccgagaaggactccgagtcgccgcgctccacatcgctacatgcggccgcacccgaccctaagtgccgcagcggcggccggcgccggcgcctcaccttgcacagcgtcttctctgcctcggcccgcggccgccgcgcccgggccaagccgcaggccgagccgccgcccccggctgcgcagccgccgcccgccccggcccctgccgcggcccagggcccgccgcccgaggcgctgcccgccgagccggccgccgaggccgaggcggaggccgcggcggcggcggcggagcctgggttcgacgatgaggaggcggcggagggcggtggcccgggcgcggaggaggtggagtgtccgctgtgcctggtgcggctgccgcctgagcgggccccgcgcctcctcagctgtccgcaccgctcgtgccgggactgcctccgccactacctgcgcctggagataagcgagagcagggtgcccatcagctgccccgagtgcagcgagcgactcaacccgcacgacatccgcttgctgctcgccgacccgccgcttatgcacaagtacgaggagttcatgctgcgccgctacctagcctcggaccccgactgccgctggtgcccggccccggactgcggttatgctgttattgcctatggctgtgccagctgcccgaagctaacttgtgagagggaaggttgccagactgagttctgctaccactgcaagcagatatggcatccaaatcagacatgcgatatggcccgtcaacagagggcccagactttacgagttcggaccaaacacacttcaggtctcagttatgggcaagaatctggaccagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttggtattggtgtccccattatgctggcatatgtttatggggttgtgcccatttctctttgtcgtggaggcggctgtggagttagcacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaa

SEQ ID NO: 5737 - DNA, 2598 bp, Homo sapiens
atgggctccgagaaggactccgagtcgccgcgctccacatcgctacatgcggccgcacccgaccctaagtgccgcagcggcggccggcgccggcgcctcaccttgcacagcgtcttctctgcctcggcccgcggccgccgcgcccgggccaagccgcaggccgagccgccgcccccggctgcgcagccgccgcccgccccggcccctgccgcggcccagggcccgccgcccgaggcgctgcccgccgagccggccgccgaggccgaggcggaggccgcggcggcggcggcggagcctgggttcgacgatgaggaggcggcggagggcggtggcccgggcgcggaggaggtggagtgtccgctgtgcctggtgcggctgccgcctgagcgggccccgcgcctcctcagctgtccgcaccgctcgtgccgggactgcctccgccactacctgcgcctggagataagcgagagcagggtgcccatcagctgccccgagtgcagcgagcgactcaacccgcacgacatccgcttgctgctcgccgacccgccgcttatgcacaagtacgaggagttcatgctgcgccgctacctagcctcggaccccgactgccgctggtgcccggccccggactgcggttatgctgttattgcctatggctgtgccagctgcccgaagctaacttgtgagagggaaggttgccagactgagttctgctaccactgcaagcagatatggcatccaaatcagacatgcgatatggcccgtcaacagagggcccagactttacgagttcggaccaaacacacttcaggtctcagttatgggcaagaatctggaccagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttggtattggtgtccccattatgctggcatatgtttatggggttgtgcccatttctctttgtcgtggaggcggctgtggagttagcacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacaggtttagcatgatccatgcatgactcagcaaagtggattttgtctccacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataa

SEQ ID NO: 5738 - DNA, 2560 bp, Homo sapiens
atgggctccgagaaggactccgagtcgccgcgctccacatcgctacatgcggccgcacccgaccctaagtgccgcagcggcggccggcgccggcgcctcaccttgcacagcgtcttctctgcctcggcccgcggccgccgcgcccgggccaagccgcaggccgagccgccgcccccggctgcgcagccgccgcccgccccggcccctgccgcggcccagggcccgccgcccgaggcgctgcccgccgagccggccgccgaggccgaggcggaggccgcggcggcggcggcggagcctgggttcgacgatgaggaggcggcggagggcggtggcccgggcgcggaggaggtggagtgtccgctgtgcctggtgcggctgccgcctgagcgggccccgcgcctcctcagctgtccgcaccgctcgtgccgggactgcctccgccactacctgcgcctggagataagcgagagcagggtgcccatcagctgccccgagtgcagcgagcgactcaacccgcacgacatccgcttgctgctcgccgacccgccgcttatgcacaagtacgaggagttcatgctgcgccgctacctagcctcggaccccgactgccgctggtgcccggccccggactgcggttatgctgttattgcctatggctgtgccagctgcccgaagctaacttgtgagagggaaggttgccagactgagttctgctaccactgcaagcagatatggcatccaaatcagacatgcgatatggcccgtcaacagagggcccagactttacgagttcggaccaaacacacttcaggtctcagttatgggcaagaatctggaccagcagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttggtattggtgtccccattatgctggcatatgtttatggggttgtgcccatttctctttgtcgtggaggcggctgtggagttagcacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaactta

SEQ ID NO: 5739 - DNA, 1458 bp, Homo sapiens
atgggctccgagaaggactccgagtcgccgcgctccacatcgctacatgcggccgcacccgaccctaagtgccgcagcggcggccggcgccggcgcctcctcagctgtccgcaccgctcgtgccgggactgcctccgccactacctgcgcctggagataagcgagagcagggtgcccatcagctgccccgagtgcagcgagcgactcaacccgcacgacatccgcttgctgctcgccgacccgccgcttatgcacaagtacgaggagttcatgctgcgccgctacctagcctcggaccccgactgccgctggtgcccggccccggactgcggttatgctgttattgcctatggctgtgccagctgcccgaagctaacttgtgagagggaaggttgccagactgagttctgctaccactgcaagcagatatggcatccaaatcagacatgcgatatggcccgtcaacagagggcccagactttacgagttcggaccaaacacacttcaggtctcagttatgggcaagaatctggaccagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttggtattggtgtccccattatgctggcatatgtttatggggttgtgcccatttctctttgtcgtggaggcggctgtggagttagcacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacagaagttcaatgcctcatgtt

SEQ ID NO: 5740 - DNA, 1992 bp, Homo sapiens
ggcctcgctccctccgatcccccccgcgcccgggacccctggccccactgttgggccagctcgccgggtccggccatgggccccgccgctcgccccgcgctgagatcgccgccgccgcctccgccgccgcctccgtctccgctgctgctgctgctgcccctgctgccgctgtggctgggcctggcggggcccggggccgcggcggacggcagcgagccggcggccggggcggggcggggcggagcccgcgccgtgcgggtggacgtgagactgccgcgccaggacgctctggtcctggagggcgtcaggatcggctccgaagccgacccggcgcccctgctgggcggtcgtctgctgctgatggacatcgtggatgccgagcaggaggcaccagtggaaggctggattgcagtggcatacgtgggcaaggagcaggcggcccagttccaccaggagaataagggcagtggcccgcaggcctatcccaaggccctggtccagcagatgcggcgggccctcttcctgggtgcctctgccctgcttcttctcatcctgaaccacaacgtggtccgagagctggacatatcccagcttctgctcaggccagtgatcgtcctccattattcctccaatgtcaccaagctgttggatgcattgctgcagaggacccaggccacggctgagatcaccagcggagagtccctgtctgccaatatcgagtggaagttgaccttgtggaccacctgtggcctctccaaggatggctatggaggatggcaggacttggtctgccttggaggcagtcgtgcccaggagcagaaacccctgcagcagctgtggaacgccatcctgctggtggccatgctcctgtgcacaggcctcgtggtccaggcccagcggcaggcgtcgcggcagagccagcgggagctcggaggccaggtggacctgtttaagcgccgcgtggtgcggagactggcatccctcaagacacggcgctgccggctgagcagggcagcgcagggcctcccagatccgggtgctgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctggggaaccgctactccgatgattagctgcccagctggactctgcacatggggatggacccttcctgcctgcaccccggtcctcagcctgggctcccaggacaggacaggatgggacagcaggatagacaggacagcaagcccagtgggtgggaggaaggatgagggccccaccatgtccacactgggaaggagggccccacagcttcagactgaggatctagggctgggacctgtcagtcaaggaagagaggtcactttgggaccttctctgcaatcctgtgacgtgagtctgccctccttacaggcagctcccaggtcaataaggaaagagaatatggggccagtgtagctgtcgccagggttctgggagctccctgtggcctgtctgggaattcctgggggctgagactacagtggccaggttttgtgcttatttattggggggtgggttgagggaagagctatctggccttggggtaccctggcctgaccgtctttcaggatacttcttgtcaaggctgtctgcctgttgcctttggtcctcaagcactgggagccatgggtcccactgcctgtccagcctggctcccttcctgggcctggctaggaccagaggtcttagaaaccgtcctgttctggaatccttggctgcggctttgtgttgctgaccgggatactcgaagccacaggatcaatgtggtgcctcatccaggggcatccttttttttttttttttttttttttaaagagttggagtagggaaggtttaatagtaaaataaacgtggctatattttaacataagatg

SEQ ID NO: 5741 - DNA, 1130 bp, Homo sapiens
atggcaccctgtactgagactaagatctttgttctttgtgatgaacagatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatg

SEQ ID NO: 5742 - DNA, 1784 bp, Homo sapiens
agtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgaaggcaaacttcataatgaggggaagagtcaagttttgtgtaacctgaagcatatacagtgtccattgccagcacttgagtaaagataaagagtaggagaatcaaagctgttgtataattagttctcttctcatccacacccataaaccagttcaagaaagggatgaaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcgttgaggaaattaagacttactggaacctcataagtggtagaaccaggaatcaaacccaacatttggctccacagcctgtgttgttaagtgatatgctatactgcctgaaacaagtgtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaata

SEQ ID NO: 5743 - DNA, 450 bp, Homo sapiens
atttagtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgaaggcaaacttcataatgaggggaagagtcaagttttgtgtaacctgaagcatatacagtctcctgcaaatgataagaggcttgaggatacttcccaggaactcctgcctttttggaggtgactctgtcagttaaagtgtgaatgaagagtggagcataaaagtccattgccagcacttgagtaaagataaagagtaggagaatcaaagctgttgtataattagttctcttctcatccacacccataaaccagttcaagaaagggatgaag

SEQ ID NO: 5744 - DNA, 2239 bp, Homo sapiens
gactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttccccagcccccgactgtccctcccaacggattccctctcccccgacggcggcagcatcgagctggagttctacctggcgcccgagccgttctccatgcccagcctgttgggagctccaccctactctggcctgggcggtgtaggggatccctatgtgcccctcatggtgctgatgtgccgggtgtgcctggaagacaagcccatcaagcccctgccttgctgcaagaaggccgtgtgcgaggagtgcctcaaagtctacctgagcgcccaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaac

SEQ ID NO: 5745 - DNA, 1122 bp, Homo sapiens
agcaactcacacctgcctcagaccagagctctgtgcgggtgacggcgcacgcattccttgtgtccccgcctgtcttggacagagcagaagccacacctgccagaccagtgccaccgggacagctgctggtggccggccccggggagggatacctgctgggtgaagcacaggccgggccgggcccggagaagaggaagcagacactgccacggcagggcagcccagggccttggagcccaaccgtggccggcgaggaggaccacgcccaggcccgctgacccccggccaccagctcagagacatgtcgtcaggccagcaggtgtggcacacggctgtgccaccccctcgccggagcagctccatagcctcgatgcccaggtcccccagctcggccggcagccccaggtcccctggcacccctggctcggagagggtggcctcccccctggagtgctccatctgtttctcaggctatgacaacatcttcaagacacccaaggagctctcctgcacccacgtcttctgcctggagtgcctggcccggctggcggctgctcagcctgtgggccgccccggtggtgaggctgtaccttgccccttctgcaggcagcccacggccgtgccgcccgccggagcccccgcgctgtgcaccagccgccagctgcaggcccggatgccggcgcatttgcggcgtgaggagcctgtgtggctggagggcaccaagctgtgctgccagccactgcccaccacacctggccgcgagcccggtttcgtatgcgtggacgtgggtttgagcaagcctgccgagccgcccgcgcccgcccgggaccctgccccccgccggggccgcctggcccgctgctgggcgcgctgcagggactggaggcgcatggcactggtctctgccctgctgctgatgctcttctgtgtggcactctggccggtgcagtgcgcgctcaagaccgggaacctgcgctgcctgcccctgcccccccggcccccggccaccagcacagccgcctcccccctcgggcctctgactgataattagggccagcagcctctgcccaggtcagccgccctcgcccagctccatggggcgtcccccactggggggcccaa

SEQ ID NO: 5746 - DNA, 5353 bp, Homo sapiens
ggggggggggcagtggcgtccagtgacgcccagtgacgtccggtgaaatccaagatggcggcgctaggctgaccctcctgctggtgacggaagtaccgcctcctcccgtttgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaatgtagtcccccgattttagctgcagcagctgagcagcactttgctggcttggtgtgagcctgggagggctcagacttaacggccggcagggatcccggactgggcctgaaggggagagcgtggtggtcgtcgcggagccgcctgtcctgctcccaccgaccccggtctgaccacgtccttggctgtcatggccgggggatgccgggactcctcgggctgcatcctgggaagtgtagttcctggtccgcacatggttaggaggttctcggagagagagctagtttcccggttgcgctggccaaaggccggcctgaactggatcctgcggaccgcttctcagcggcttcacccccacaccactcgaatgcacagatcgggacacctcagctgggtgacttccctcgttgcaatcggcctcgggagcggtgcggcgtgtaccgagcggcgcccctgggctcagcgcgctgcaggcgccccgggcggatccttcaccgaggcaggactggggctggcgccagagccggtgcggagcggtgttggttcaggcgctggcgacagtgctatggccacggcaggggccgcgtgcgtctcagcggtggcgccttcggaccctattggcgcccgggacttaagcggggccgccgctgctggaccaggacgaactggagaaggagacgcgggccgccacggtgacctcgggcgtagggccggcggcggcgggcacgctggtggaagcgcgggccgcggcaggggaggacatcgggccgcagagaaagtgccgatggcctggggcagcggtgcgagggtgggaaaaacgcaggatattgcatcatagagacgcggccaccttcgcccctggagagcgccagtctcaggagcgccgcaccggtcacgggtggaggtcagccaggcctccgtaagcgcggtccccttccaggagtagccttcgcctgggctcttgagtagatgccaagtaattccgcatcgtctctctagatatctgcgctaaaggccacccggtctccttatcagaggggcaaaactctcctcgtgggtcttcatacctaataaaagtcggcatcaaaccac

SEQ ID NO: 5747 - DNA, 3930 bp, Homo sapiens
agtgacgtccggtgaaatccaagatggcggcgctaggctgaccctcctgctggtgacggaagtaccgcctcctcccgtttgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcacccc

SEQ ID NO: 5748 - DNA, 2634 bp, Homo sapiens
gtgaaatccaagatggcggcgctaggctgaccctcctgctggtgagggctctggcgccgggggggacgggatccagcaggtgacggaagtaccgcctcctcccgtttgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatg

SEQ ID NO: 5749 - DNA, 1161 bp, Homo sapiens
ttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgc

SEQ ID NO: 5750 - DNA, 1745 bp, Homo sapiens
gaaatccaagatggcggcgctaggctgaccctcctgctggtgacggaagtaccgcctcctcccgtttgacgcccctcagaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggtggggctgtgggccaagttgtgccctatccacctgagaattgtagatgcaggattgctgagactagtggagagtctggggaccctggaagtaatgtagggcagcagaaagtgggcagcacagtggtcacagagtcaaatgctgtttgctgtacatgtactgtgagccaggcacagtgcttggctgggtgtgggttgggaggctaggaactggccctggtctctgacttcttgaaactgacagtcaggggaggaggcagccaagtaattctctcatcccagatgtgtaatatgatggcagaggccagaggggctgaggggactcaggggaggcccttcccctggccctggggtcagcaggcttcctggagtgaatgtcaccacagcagacctgaagaataggccagacgtggctgtgaggaacgggagtgagtagctttaggcaaagggaacagcagatgtggacgcttgagcggaggggttgctgggacagcaccggaggttgtaatcagaggagccaatgtggagaggttgggccgtgtcacctcctgaagagtgcggtacgccaggttgagacctcaaagggttttaaac

SEQ ID NO: 5751 - DNA, 2101 bp, Homo sapiens
gaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatttgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattcattttgtctctggacgtcataaattcttcctgccatcagctttaatgttcatgatcatgctttttgtatagtaccatggagtatctcgaagtaactattaaaataattcatgtggattataaa

SEQ ID NO: 5752 - DNA, 1218 bp, Homo sapiens
gttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatttgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactat

SEQ ID NO: 5753 - DNA, 3882 bp, Homo sapiens
acatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggctgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagcacgtgttctgtgaggagtgcctctgcctgtggctggaccgtgagcgcacctgcccgctctgccgctcggtcgccgtggacaccctgcgctgctggaaggacggcgccacgtccgcacacttccaggtgtactaggaccgaacactgaggacacccagaaggacgccaagggtcagcatgcccggacccagccctgcgggggcttcctgagaaacaggcctcaagcacttacatcctgcctcttgccctccaccacctctgaccccaaagtcccgcccctgtcttgtccttctgaccttcatcttcctctctcgttctgtggtatagtgcgtgcctccttcccctgcaaaaggggacgtcttcctaactcagacttgatgcccttctagatgcatcttccttctccactccaagtcaaggacctggcaatacatgaagttcccacttgttggttattttctctttcttttttcttttcttttctttctctctctctctgtttccctccctccctccttccttccttccttccttttttttttttttttaaaacaaggtctcgctctatcacccaggctggagtgcagtggcacaatctcggctcgctgcaacctccacctcctgggttcaagcgattctcctgcctcagcctcccgagtagctgggattacaggcacccaccaacacacttggctaatttttgtattttttagtagagacagggttttgccatgttggccaggctggtctccaactcttgacctcaaatgatcagctcgcctcagcctcacgaagtgctgggattacaggcatgagccaccgtgcccaggctcacttttttttttttttttttttttttgagacagggtctgggtcttcacccaggctggagtgcagttggcacaatcacagctcactgcaaccttgaactcctgggcccaagccatcctcccgcctcagcctcccaagtagctgggactacaggtgtgtgccaccaggcctggctaatttttttttttttttaatttttagtagaggcgaggacttattatgttgtccagggtgttctcaaactcctgggctcaagcaatcctcctgtcctggcctcgcaaagtgctgagtgctggaattacaggtatgagcccctgtgcccagcccacctgctggttattttaacttagtacctagtacctaggacttgatggtgcaggctggggaggagcctagagatcactgcctcccagatagcccaggcctgcagattagaatccctgtgagccctgtgaagtattttttcttttcttttctttttttttttttttttgttgttgtgagacagagtcttgctctgttgcccaggctggagtgcaatagcacgatcttggctcactgcaacctccgcctcccgggttcaagtgattctcctgcctcagcctcccgagtagttgggacaacagatgcgtgccaccatgcccagctaattttttttttgtatttttagtagagatggggtttcaccacgttggccaggctggcctcaaactcctgacctcaagtgatccacctgcctcagcctcccagagtgctgggattacaggcatgagccaccacacctggcccaaagtattttcaaaatacagttgttgggccccaccatatacctgtaatgacttaaggtcccaaatacttcatgcgcagcaggcaaagcatgcagcatcctgcttggattacgtgctgtcatcctcacaacagccctgtgatgggggaggtactgttgggtcccctgttttatagatgaggaaacttgggcacagagcttggtgcggtaactttcccagggtcacccagccagcatgggcgggccaagtttccaacagaggcctggtacagtttcagaacccacatctaaaaaaaaataaatttattagagatgaggtttctaataaaaatccaggttgtccaggctagattcaaactcctgggctcaagtgatcctccctcctcagcctcccaagcagctgcaactacaggcacactccgctatccccagcagagcccgcactcttaacctccgcactgctctgcccctcagacattccaggcatggggcccagcagacacggtcttctaaaagcacacgagaggccgggtgtggtggcccatgcctgtagtgccagcattttgggaggctgaagcaggcgggtcacctgaggtcaagagttcaagactagcctggccaacatggcaaaaccccctctttactaaaaaatacaaaaattagccgggcgcggtggcgggtgcctgtaatcccagctactcaggaggctaaggcagggagaactgcttgaactcgggaggtgaaagttgcagtgagccgagattgcaccacagcactccaacctgggtgacagagtgagtgagactctgtctaaaaaaaaaaagaaagaaa

SEQ ID NO: 5754 - DNA, 2896 bp, Homo sapiens
acatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggctgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagcacgtgttctgtgaggagtgcctctgcctgtggctggaccgtgagcgcacctgcccgctctgccgctcggtcgccgtggacaccctgcgctgctggaaggacggcgccacgtccgcacacttccaggtgtactaggaccgaacactgaggacacccagaaggacgccaaggattcaggacatttgcccctgtgtgccaccaaaccaggactttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccctgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggggaacgtcccatctgaggttttcttctcggtggggggatttaacttctgtcctagggaaaacagtgtctgatgaggagtgtttccaacacaggctacatgaattcccctataccagtgcgaaagcagccaggagtccccgttggaaaagaacaatgccactctcttttatgtatcttggttctgcaactcatttgttgtaagtagggttaatcgagtatcaggttcacagtatcctgcccttattattttatgattcactgactcaagttccacgaagtccttagaaatggacctcttcatgtaaaatatcttgagaataataaatgtgagggaataagaaaggcaagctttggacacagatatgataggtgcatcagcttcggaagagaagaatgatgtgcagagtgttaggaagacatccgggctgctgagactcgggattagaagaaagagaggtaaataaagtgggtcctggaatcttttaggacttctgctgtaggacaaacagctgcctttggtgttttaatgtctcccaaagtacccttcagccaataaataccatctgttggtgc

SEQ ID NO: 5755 - DNA, 2415 bp, Homo sapiens
acatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggctgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccctgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggggaacgtcccatctgaggttttcttctcggtggggggatttaacttctgtcctagggaaaacagtgtctgatgaggagtgtttccaacacaggctacatgaattcccctataccagtgcgaaagcagccaggagtccccgttggaaaagaacaatgccactctcttttatgtatcttggttctgcaactcatttgttgtaagtagggttaatcgagtatcaggttcacagtatcctgcccttattattttatgattcactgactcaagttccacgaagtccttagaaatggacctcttcatgtaaaatatcttgagaataataaatgtgagggaataagaaaggcaagctttggacacagatatgataggtgcatcagcttcggaagagaagaatgatgtgcagagtgttaggaagacatccgggctgctgagactcgggattagaagaaagagaggtaaataaagtgggtcctggaatcttttaggacttctgctgtaggacaaacagctgcctttggtgttttaatgtctcccaaagtacccttcagccaataaataccatctgttggtgcaa

SEQ ID NO: 5756 - DNA, 1819 bp, Homo sapiens
cgctctggtcggctgtgtagactgttgggtaggctgcgtgctagcttcggcgcggatccctgggcgtccgtacgtcggagtccttcgtcctccagggtccctgttctttgcgccagcgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtggctcaaatgagaacatttgatggcttaaaaagtaaatgcgttagaaatacagttctgttaatgtatttcttcccaaacaattcatttttctcttctaaaggtagtctttcccaactgactgtagggttgtgtcttttcccaattaaatatctgcagaactttgggattatactttgtttactgtagaaagataataaaaagagttgtccaagattgttgaacagaataatctttatcccagttaaatagttgtaccattggtagacttttttatggaggttcctagagggtggtgccctggggtgggcttggaagctctgcaccccttcccccatagctttccccgtgcatctctttgtctgtatgttttgtaatatcttttacagtaaactggtaaatgtgtttccttcaa

SEQ ID NO: 5757 - DNA, 1017 bp, Homo sapiens
ggggtgggaggacgccggagacgttccaagatgcacttagtggagcatgtgcgttcggaaggcccacgggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtctttt

SEQ ID NO: 5758 - DNA, 2508 bp, Homo sapiens
attgtagtcgcccttctccacgtggtcttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactgggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcggcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaaatctctgttgtggaagcgtatcttctgttcttaggtctcaggaaggagagggctatactgaacaccattagggatagatggaaatgaccttggcctccctgctcagctggtccatctagtttccaccttgtttcttgcaaacaaatacacctcacactactttttctttctgacagagttggagtgacagcacagttaggggggtacaccccgggacagtctttatatgttccctctgtatagatgatgccactttctagccctttccctgtctccatggtacccattactgtgcataataaatttaactttgaaagca

SEQ ID NO: 5759 - DNA, 2053 bp, Homo sapiens
cttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactgggccatcactgtgcatgtccccatgccctcagcaggagtcgtggacatccccattgtggagaaggaggcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcggcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaaatc

SEQ ID NO: 5760 - DNA, 1704 bp, Homo sapiens
gcatcccggcatctgcacgtggttatgctgccggagtttgggccgccactgtaggaaaagtaacttcagctgcagccccaaagcgagtgagccgagccggagccatggagggccagagcgtggaggagctgctcgcaaaggcagagcaggacgaggcagagaagttgcaacgcatcacggtgcacaaggagctggagctgcagtttgacctgggcaacctgctggcgtcggaccggaaccccccgaccgggctgcggtgcgccggacccacgccggaggccgagctacaggccctggcgcgggacaacacgcaactgctcatcaaccagctgtggcagctgcccacggagcgcgtggaagaggcgatagtggcgcggctgccggagcccaccacacgcctgccgcgagagaagcctctgccccgaccgcggccacttacacgctggcagcagttcgcgcgcctcaagggcatccgtcccaagaagaagaccaacctggtgtgggacgaggtgagtggccagtggcggcggcgctggggctaccagcgcgcccgggacgacaccaaagaatggctgattgaggtgcccggcaatgccgaccccttggaggaccagttcgccaagcggattcaggccaagaaggaaagggtggccaagaacgagctgaaccggctgcgtaacctggcccgcgcgcacaagatgcagctgcccagcgcggccggcttgcaccctaccggacaccagagtaaggaggagctgggccgcgccatgcaagtggccaaggtctccaccgcctctgtggggcgctttcaggagcgcctccccaaggagaaggtgccccggggctccggcaagaaaaggaagtttcaaccccttttcggggactttgcagccgagaaaaagaaccagttggagctgcttcgtgtcatgaacagcaagaagcctcagctggatgtgactagggccaccaataagcagatgagggaggaggaccaggaggaggccgccaagaggaggaaaatgagccagaagggcaagagaaagggaggccggcaggggcctgggggcaagaggaaagggggcccgcccagccagggagggaagaggaaagggggcttgggaggcaagatgaattctgggccgcctggcttgggtggcaagagaaaaggaggacagcgcccaggaggaaagaggaggaagtaatagtttctaactgtcggacccgtctgtaaaccaaggactatgaatactaaatgttaagttctaggcaattatacggggactcagaaggacctggccgctgccttcattgagtttaaagggacaggattgcccttccgtcaagaaagtatgtaagtgttggactgcacaaattaatgtttttcccacaaccgagactttggagattaagaacttatttgaggatttaagaattagggaaataatttggtggaaaccgggaatgagttctattcttaaacagcctttttttttctttttaatgttggatatacggcgaggtagagttggccatatttcagagacttagattgacgtatatgtttctgcattatttttacaacaagtttgtgtatcagagcgggagtgcgggggagggaaagaaaacaaacagtttcagaattgaataggcaagtgactgttttaaagattaagtaataaagatgtcttatctagtgtgactttt

SEQ ID NO: 5761 - DNA, 2646 bp, Homo sapiens
gacacggccaagatggccgaccgggaaggcggctgcgctgctgggcgggggcgggagctggagccggagctggagccggggccggggcccgggtcagcgcttgagccgggagaagagtttgagatcgtggaccgaagccagctgcccggcccaggcgacctgcggagcgcaacgaggccgcgggcggccgagggctggtcggcgcccatcctgaccctggcacgcagggccaccgggaacctgtcggcgagctgcgggagcgcgctgcgcgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcactctggtgcgtgca

SEQ ID NO: 5762 - DNA, 2560 bp, Homo sapiens
aacaacccagtcttcagaatgcaaaggtgccttgcttatgtcagaaagggcctctcactgcggtccctgcccacatcactctcagaccacctggatcccttggacggggactcccttcatggcctgtgggcctttgcatgccaaagttcctactcgttcttcagcatccactcacctgccatggcctcccaaagtgctgggattacagtcatgagccaccgcacccggccaagtcttgttctgttttaaagaaaattaaatttaaattgctttatcaatgtaactttttttttttttggaaacagagtcttgctgtcacccaggctggaatgtagtggcgtgatcttagctcactgcaacctccacctcccggattcaagcgattttcctgcctcagcctcccaagtagctggaattataggcacatgccaccacacccgactaatttttgtatttttagtagagacagggtttcaccatgttggccaggctggtgtcaaactcctgacctcaagtgatctcccgccttggccttccaaagtgctgggattacaggcatgagccaccacacccagcctatgaacttaacttttcaaatatctattgacttattctcattcttcttttttttgtttttttttggtggggggatggagtcttgccctgtcgcccaggctggagtgcaatggcacgatcttggctcactgcaagctctgcctcccgggttcacgccattctcctgcctcagcctcccaagtagctgggactacaggcgcccaccaccacgcccagctaattgtttgtgtttttagtagagacggggtttcaccatgttagccaggatggtctcgatcgcctgacctcgtgatccgcccgcctcggcctcccaaagtgctgggattacaggcgtgagccaatgcgcccagccaagttttaacctttttctaccatgcttaaaaaataaaaattaccttacattttttaaaattgtggtatattttgaaatacttcataattagcttgctttccataagcaaacaattcctcttggtgtccttgtttgatacagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttc

SEQ ID NO: 5763 - DNA, 2771 bp, Homo sapiens
atggccgaccgggaaggcggctgcgctgctgggcgggggcgggagctggagccggagctggagccggggccggggcccgggtcagcgcttgagccgggagaagagtttgagatcgtggaccgaagccagctgcccggcccaggcgacctgcggagcgcaacgaggccgcgggcggccgagggctggtcggcgcccatcctgaccctggcacgcagggccaccgggaacctgtcggcgagctgcgggagcgcgctgcgcgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagaggaagagagaatgaaaggacaggacaaaggagggctgagccgaggaagagagcttgctgccagctgcccggcagtctccttgctggacacatcttgtctcctgttagcaggaggggggtgctcagcccttctgaggctttccacagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcactctgg

SEQ ID NO: 5764 - DNA, 2454 bp, Homo sapiens
aaaaatggaaccggggttgcgggagaagccaaacgcggcgagtcttgctaaagccgtcgccgtagcaacgcgcggagccgtctgggagaggcctctggagcaggaggcccagtggctcttctgacccaaggccccgccgtccagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttca

SEQ ID NO: 5765 - DNA, 2642 bp, Homo sapiens
aaaaatggaaccggggttgcgggagaagccaaacgcggcgagtcttgctaaagccgtcgccgtagcaacgcgcggagccgtctgggagaggcctctggagcaggaggcccagtggctcttctgacccaaggccccgccgtccaggtagggggctgtggcctctagggatcagggactacttacctgcgaatcccggttgcccgcccgccagcacgtccgttccctaagcagaccgcctggcctcctgcctgacccgtcttctcaccgttgcccggagtctgacctccccacgctcagtccactaacgaagctatccctgctcctgccccacagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttc

SEQ ID NO: 5766 - DNA, 2846 bp, Homo sapiens
gcgtgggcggcgcggctggggcggccgggccggagttgcctcccgggggcccgcggcagggccccgccgccgccgccgctgctgcttctgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagctccttaggttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatatt

SEQ ID NO: 5767 - DNA, 2887 bp, Homo sapiens
cggacgatgcagcgaggaggcggcggcggcggcggccatgcgtgggcggcgcggctggggcggccgggccggagttgcctcccgggggcccgcggctgagggccccgccgccgccgccgctgctgcttctgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagctccttaggttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatatt

SEQ ID NO: 5768 - DNA, 2783 bp, Homo sapiens
tgagggccccgccgccgccgccgctgctgcttctgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatatta

SEQ ID NO: 5769 - DNA, 455 bp, Homo sapiens
aaactcctctttgattcttctagctgtttcactattgggcaaccagacaccagaatgagtactaaaaagtctcctgaggaactgaagaggatttttgaaaaatatgcagccaaagaaggtgatccagaccagttgtcaaaggatgaactgaagctattgattcaggctgaattccccagtttactcaaaggtccaaacaccctagatgatctctttcaagaactggacaagaatggagatggagaagttagttttgaagaattccaagtattagtaaaaaagatatcccagtgaaggagaaaacaaaatagaaccctgagcactggaggaagagcgcctgtgctgtggtcttatcctatgtggaatcccccaaagtctctggtttaattctttgcaattataataacctggctgtgaggttcagttattattaataaagaaattattagacatac

SEQ ID NO: 5770 - DNA, 2415 bp, Homo sapiens
tgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaaattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagc

SEQ ID NO: 5771 - DNA, 2503 bp, Homo sapiens
cgcctccagcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaa

SEQ ID NO: 5772 - DNA, 1416 bp, Homo sapiens
tcaaaattccgtcttcaagaagaaacacccgtggaggaagaagacattatacaaaacaaatttagaaactgtatgtatagcttcatgtttttcataaaataggaatgaggacaaatgttgctcttcatcctaccagctgtttgttctttggtaggggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaattaaa

SEQ ID NO: 5773 - DNA, 1348 bp, Homo sapiens
aacagaagaatcagaagcttttcaaaattccgtcttcaagaagaaacacccgtggaggaagaagacattatacaaaacaaatttagaaactgggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaa

SEQ ID NO: 5774 - DNA, 1386 bp, Homo sapiens
aacagaagaatcagaagcttttcaaaattccgtcttcaagaagaaacacccgtggaggaagaagacattatacaaaacaaatttagaaactgggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatgttcagaggtatatgtgcaggtttgttatacaggcgggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaatt

SEQ ID NO: 5775 - DNA, 810 bp, Homo sapiens
atgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatgttcagaggtatatgtgcaggtttgttatacaggcgggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctag

SEQ ID NO: 5776 - DNA, 1027 bp, Homo sapiens
tatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggtcctggatgaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaattaaa

SEQ ID NO: 5777 - DNA, 1456 bp, Homo sapiens
acaaaacaaatttagaaactgtatgtatagcttcatgtttttcataaaataggaatgaggacaaatgttgctcttcatcctaccagctgtttgttctttggtaggggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggctggagtgcagtggtgcgatcttggctcactgcaacctccacctcctgggttcaagcatttctcctgcctcagcctcccgagtagctgggaccacaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagt

SEQ ID NO: 5778 - DNA, 2234 bp, Homo sapiens
ctctctttctctccctctttttctctccgttggatccacctcctattccctcaactcttttagcataaccttcaaaggagaacgttcccttctgacttgattatcttcttttccccactgagaaaatacctctcagctacaagacattttttaagtctatgcaggacttcggggattctgttatcttgccggggaaactgatcattgctaatgcctgggactggagctaaattacctaccagagtaagcctgacggaggaagccttttatcatacactcttctcttcagtttgaacacatttgcttgaaatttgccgcatgatgctgaccagggaagcagctttttttctcgggatgcagcaattcgctgggttctaagcttattgcagaagaagaaataatcttaaatagagtggatttttttttccttttttcttttggcccctgtttcaatcgactcagctgtgttgcaccgcggtagagatcacctgtcactaaatctttgaggaagtaaaataaagtgaattatcattattatttatttattttccttatttttaacccggtggaggcggcgtgaccacggagaatgagactgagaggagctgccggggcttggaggaggataaagctgagtttaagctggaaactaaaagactagattgtttttgggtgccactcgcccggttcctctccacttcgtttagttgcgctccatggacagatcaacgaacctggacattgaggagctcaagatgacacgagaacaatacatactagcaacccaacagaataacctgccaaggactgagaatgcacaactttacccagtgggaatttatggatggcgaaagaggtgcttatacttctttgtccttctgctgttggttaccatgatagttaacttagccatgacaatatggatattgaaagttatgaatttcactgtggatggtatgggaaatctgagagtcaccaagaagggaatccgacttgaaggtatatctgagtttctacttccattgtatgtgaaagaaattcattctcgaaaggatagtccgctggtcttacagtctgacaggaatgtcacagtgaatgcaagaaatcacatggggcagttaaccggacagctgaccataggagctgatgctgtggaagctcagtgtaaaagatttgaagtgagagccagtgaagatggcagggtgctgttttctgcagatgaagatgagattaccattggggctgaaaagctgaaagttacaggcactgaaggagccgtatttgggcactctgtggagacgccgcacatcagagcagagccatcccaagatctcaggcttgaatcacccaccagatccttgatcatggaagctccccgtggggtccaggtgagtgctgctgcaggagacttcaaggccacctgcaggaaggagctccatctgcaatctacagaaggggagatatttttaaatgcagagacaatcaagctgggaaatctaccaactggctccttctcatcttcttcacccagctcctcaagttctcgacagacagtgtatgaactctgcgtctgccccaatggcaaactttacctttctccagcaggagtaggttccacttgtcagtccagtagcaacatctgcctgtggagctgaagtgactgatttctcctcacaccagaatagccttttgttcctgtccgtctgcttcacagttctgctcggtttcccttgtgatcagtccagagcttcttcgaatggtccacagagcaacttccagtgtgagcagggattcgccaccaccttctcttgtgatttactgtactgctcaacacagagggtgtgattgacacagcagtggaaaaagcgtcgtcagcaggaaaactggatcatgacttttgctcgaaagggagaataacataggtgcctttgctacgcgaagtgaagcacacagttttagatttttgcaggacctggatatgaactgcacatatatacattacataaatgaaattcccagtatccaatggcaagatgaaatggttaaccctgtaagaaaacttattctacattctgaaagcacaattttccattcatctttttggatgtaaacttttatccccgacttttaaaattttaaagcattatgtaatgcttgctttactaaaatttaaattcaatacatggtttttaacaaaacagaacaaaacaaaacaatacagaatctctccctga

SEQ ID NO: 5779 - DNA, 867 bp, Homo sapiens
atgacacgagaacaatacatactagcaacccaacagaataacctgccaaggactgagaatgcacaactttacccagtgggaatttatggatggcgaaagaggtgcttatacttctttgtccttctgctgttggttaccatgatagttaacttagccatgacaatatggatattgaaagttatgaatttcactgtggatagtccgctggtcttacagtctgacaggaatgtcacagtgaatgcaagaaatcacatggggcagttaaccggacagctgaccataggagctgatgctgtggaagctcagtgtaaaagatttgaagtgagagccagtgaagatggcagggtgctgttttctgcagatgaagatgagattaccattggggctgaaaagctgaaagttacaggcactgaaggagccgtatttgggcactctgtggagacgccgcacatcagagcagagccatcccaagatctcaggcttgaatcacccaccagatccttgatcatggaagctccccgtggggtccaggtgagtgctgctgcaggagacttcaaggccacctgcaggaaggagctccatctgcaatctacagaaggggagatatttttaaatgcagagacaatcaagctgggaaatctaccaactggctccttctcatcttcttcacccagctcctcaagttctcgacagacagtgtatgaactctgcgtctgccccaatggcaaactttacctttctccagcaggagtaggttccacttgtcagtccagtagcaacatctgcctgtggagctgaagtgactgatttctcctcacaccagaatagccttttgttcctgtccgtctgcttcacagttctgctcgg

SEQ ID NO: 5780 - DNA, 5433 bp, Homo sapiens
ctggactacggcgcgggagagggggtaggagggcccttgaagggtgcgcgttcccgtggcggtgcaccgggtaggtttcagtcagagtcactatggcggccggcgctggcaaggtcggaaagtttcctgcctcgtcgggcgcagcttgagcttgccccatcggccgcgatcggtggaggctgcggcggatccagcccggggcctcaaggcctctccccaacctccgggccagtctccctcccccaccttctcgtccgccgggagctgcggctgccgtccctgagatgcgaccctcgcgggggcgaccctgaggggaggcggcccatgtgctgagcggcggcccagaagcctaggcgtccggggaccaacttcctgccgcctgggaactcgagcctcccggtgtcgcgcctcgctcggtccgcaccggcctgcggagccgggtccccgccctggtcgcggggacgctcgccaggtgcccaggagtcccgacttggccactgcccgcgccccgccggcctccacgcctcgcgcggagaacctcagccaccgccgtctcggatcgtgccaggccggggaccgcgtcccccttcccggggcggcctccgctcagcaggggcgatgcagactgtcccgccggccgtctagagcccctccgtctccgtcacctctcgccccttcactccgggcgaggactggcggtggctgcccagaggtgcccagccacaccttccttcggcccaaaaggactttcctggccgcgccgaaccgacccttcattcatgctgcagtgctgcaacgtttccgccaccaagggggaaaagcggccgcgatctcaaaccaaacacaagaattggcgtgtgactcatctgcttggatacctccagtccccaaactgtgttccaggagttttcttggccgaagctgcccgatgtttgagccttttcttcccagagaagaagatggactgaaagctgccagttggggactttttgtgatcacggcgttgcagcgttttaaaggaggtgatggggcttgcgctggcttgtcttcccacccaagtgaagagttgatgttcactggttatgcttagacaatgtgcagtttgtgttaatttaaaattttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 5781 - DNA, 4420 bp, Homo sapiens
tttaaaggaggtgatggggcttgcgctggcttgtcttcccacccaagtgaagagttgatgttcactggttatgcttagacaatgtgcagtttgtgttaatttaaaattttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctccct

SEQ ID NO: 5782 - DNA, 6749 bp, Homo sapiens
tttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggggatacaagttgatgacttcttacctaaaataaatgggagcacagaaaaagagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaaggtactttaacatgtttttatgacatcgtaaaccagggtatcaaatcaccctttgccataaaatctgttctagatattatgtgaagttttaatttttagttaagagattaagataggttctgtaaagtagcagggactaaaaatttaaagttttggtgtttatacccaatatttcaaactattgttgaataatttggatcagtcaagattacgagggacaaagtgttaagtggtagaatatgaaatgcagctgtgttttttgtttacccttgtgtctctaataggaatttattagcgcttttaacataattagaataaggtgaaaatcttaactttcttgaaagactcaccggtttactctgttatcatatggtagcagttgtaaatttccttattttctggtcttcttcatcttctaataaatatccccaggttcttatgacactcttctagaaattttgggctaagaaactttaggtggatggccaggcatggtggctcacgcctgtaatctcagcactttgggaggctgaggcaggtggatcatctgaggtcaggagtttgagaccagcctgaccaacatggagaaaccctgtctctactaaaagtacaagattagccgggtgtggtggcgcgtgcctgtaatctcagctactcgggaggctgaggcaggagaattgcttgaatgcaggaggcagaggttgtggtaagaggtcatgccattgcactccagcctgggcaataagagcaaaactccatctcaaaaaaaaaaatgaaaaaaagaaagaaattttagatgttgataagataagtaatgcatgtaattaactctttgtctcacctctaaacaggaagtacatttcttgatatttacttgtttagaatgaagtgggtagaaaataaatcagcatttataaaaatgtttttaaaataaagttccttggggatagtttactggaaaattgtcaacattcagtctcttttatgttgccttattgtacacaagaaaaattgacatatgttgtaagttcagcccagtgggtttattaaaaatgttggtagtggtgtactaacaccagacagctctctgggatcagagtgacagtagcagcctgtggaaatttctctttgtggaagtgccgatttttctggctggactaatagggaatctccttgtccagaccccgagctttgggattatataaggaaggagcactcttactgatttgtactcttcttaggtgatctttggtgttgataagacatgctttttttctaatgtcataataataaatataagttaatgttggtatgatccagaactctcatctcagaaatgcaataccattattgtgtaaaatgtagttactgatactgaaagaatgtcagaccctatgggcctttatgggaacgtggagaaaaaagaagggaggtaaatgagtaatgaacacacccatacaaaagtagccctctttatggtcttttgcactacagaactctcttttttctttttctttttttctttttgtaggtacatagtaggtgtatatatttatagggtacatgagctgttttggtacaggcattcagtgttacagaaatcttttcaatagccaacttaagattgagtatagtgtttatgattgtgttaattgtattcaactattattagtgcttttgtgatttttgtcagtctgttttagatttgatttttatcccattgcctaccacaatgcaggtattcagtaaaactcagatatttgatgaattaattgataatggacttcttacattaaaattataaagacacaagagcattaggaaagtaacactagccacaaagctaagagccaaagaactctgggttcagtcataggtttgccatttatttgtaatatgtccttggcaaattgcttaactgctctgtgattcagggttttttcatgtattagactggcgaaaaccaactttataggtttattgtgaagattgaatgaaagggtgtgcatggaccacttaccatggtgttgggaacataaaatgttaaccaccataatgaagacactgatcatgatgatgatggtgattgataaaagcaggcctatctgttgaaggactctgagtaactccatattaattgaataagattgtggagttttaaaattatttcctatagtatttaggaacaaggatttgtttgtaatggattttttctaattagtaatgcatttatttgtttgttacttgccagataatcaggaaaaaatatttttaatccatgagtagcaccaaacagtatctataaaagtactcacaatatagcctgggaagtcagactcaaggaacagggaatgaaaggggaaagatgtaggaaaagattggaaaatacaagatgcatgtggagctggcggcctgtgtgcagatgctattagtaattgcttcaggtgccattgatgaagatgggtcagagtttccctaaccttgctttacgttaaggtgaaagaacttctaaaacttttctttacatttctgtatgattgccaacttttttgttaatgaagtagtatctttataaatacctgctgaaagattttgtggcttgattttatttttatgaatttttttacttattttgttttgttttgtttttagagacaggggtcttgctaagttggtcaggttggtcttgaacttctgagctcaagcgttcctctcacctcagcctcccacctcagcttcccaagtagctgggactacaggcatgcaccaccctacccgacttgtttactctttcactttgtttctctttctctctctgtctctctctctttttgcagcttgattttaagaacagactgtcaagtcagtcagtgattggatgtaaagaaaaatcatctaggtagaaggaggcatattttagaagagtctccaagagataattatcatagccctttatggtcattattatttttcttttgtaaagtttctcttgtaagagttttacaaattcttaaaagtgatgtattactggtactttttagaaacatttatgttatgcttgattatgtgtggttatggtttgtatctgtataattaggttcaatagactgacataattttctcttaaaagtataaattactagacaacagtgttgacctttacagctatataaggcagctacatataagtagcctctttattttcctcattcaaactttgtgcctgacttcccgaaccattattttcaagttttttttccccttttttaaaaaatagccaatctttttctttagatttattgtgtacgacttgtcacatttgtcagctaggacaaggaaaataataataaacattcattatgagataaaatgatgatagcagtagtaccttttccctgatatagtaatcatttctatctatttagttacttttaaatgagaaataagttgatcaaaccatgttttctgtatgcttgaaaccatctcccataaaacgttttttaaaattggaattcacttcaaatcatgtctgttgcaaatttgctctgtttggggaaccttgccagggactgcagtggttttaaagtctaataagactgtcgggccggacgtagtggctcatgcctgtattcccaacactatgggaggctgaggcggcctgatcacttgagcccaggagtttgagaccagcctgggcaacatggcaaaaccccatctctacaaaaattagccaggcatggtggtgcatgcctatagtctcagccactcagaaggctaaggtgggaggatcacttgagcccagacggcagaggttgcagtcagcccagatcgtgccactacactctagcctcggtgacagagcaagactctgtctcaaaaacaaaagcaaaaatctatcctctggatttaaggaatttcaaggcaaattagtgatagtacattttttaaaactttgtattttccttgtgcctcaacatccccacaaacaggccgtgaacactctgccctggcaaccagatgcaccagtatgataaggctggtccctgccacaagttccccttcataaccttccctggcagtgccctagtgaaatttaacgaaatcacctcatgccttttgtttgtgtatcctgacccccaatacaagcatttgcctacaggtcctcactctatcagttatacctatttggctgaacccattctttgggcttctcccatatggttccctgcatggtgtaccttgcctccctctctaggacctttgagtataataaatcctttaatttcatttacctctccaagtataattcccacagctatgttggagtgatccttgaggaccccacagggagacttactccctcccccatttaccacacagagagttatagatgataagctgattattggtggttgttgccatcagcagtcaaagaaaagagaatgcccagggtttttttgtttgtttgtttgtttcagaggatagagaagaaaggcattttgagtttcatgggacaagagtcatttgaaatgactctataaatagtgtgtcttaccatatgtgatatattcagtgattaagaaaaactaaacctaaatctgatcaagactctagctccaactgccagtttgcaggacatacaaagaactaggcacatattctaaatgatgtgatggggatacaaccagcaaaatccagaatgtggaagattctacaggacatacaacccagtttctttagcaattaaattagaaggggaaaaaaaggaaaggggatgggggaaatcctataaattaaaagagatttaagagttatgtcggccaggcgtggtggctcacacctgtaatcctagcattttgggaggccaaagtgggcagatcacttgaggtcaggagttcgaacctagcttggccatcatggtgaaaccctgtctctactaaaaatacaaaaaattagctgggcttggtggtgcacacctgtaatcccagctacttgggaggctgaggcaggaaaatcgcttgaacccgggaggcagaggttgcagtgaaccaagatcatgccaccacactccagcctgggtgacacagcgagactccatctcaaaaagaaaaaaagagagagagatgtcaactaaatataatgtatgaaccttgtatgaatcttcattcaaacaattcaactgtaaaataaatttggaacaatggaaaattttaa

SEQ ID NO: 5783 - DNA, 2368 bp, Homo sapiens
tttaaaggaggtgatggggcttgcgctggcttgtcttcccacccaagtgaagagttgatgttcactggttatgcttagacaatgtgcagtttgtgttaatttaaaattttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagaggtaaagcgaaaagacattatgagcccaattatggttggacttaaagccaaaagcaaatcggatatccatgctagttag

SEQ ID NO: 5784 - DNA, 3066 bp, Homo sapiens
agaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacac

SEQ ID NO: 5785 - DNA, 4132 bp, Homo sapiens
ggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactcca

SEQ ID NO: 5786 - DNA, 2274 bp, Homo sapiens
agggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagaggtaaagcgaaaagacattatgagcccaattatggttggacttaaagccaaaagcaaatcggatatccatgctagttagaaataaagggaagcagaagtcacattacctgtcacaaaattgatacttggaacatctctgcttggtgatttctagctgcatatcatggtccatatgtagagaattcttcagtagggttggtctcaaaaatataatatacaaaactacattttaatttttctctaccagttacttatatgagaaatcctttgtaccaggtctcttgatctattgtttaactttcaaagagagtatcgtatgtaacttagcatacttttggaaagcaaactgaggccatactctaatgctgtctgaacccctcaggtaaatatggcctgaaaagttacttaaaattcacctcatagccaggcagccagccaaacacatgttctgtggccttttactttcttcctcccacccccttttcaccttattcataaatgtgcatgctcacttttcatgtcattctgcttaaaaccttgagttgagtggctttttaaaaatttgtgttgaagtcataacagttgattttggaacagaaaccctacccagtttcttcctgagcaagagaggtgcatttcacttcccaaagccttgaagttgacagcagggcagtaagagctgtcttcagtcctgctggcctcataccactccctgcattgactcctggccagctcggggaatggagaagcctgatacaacttgatctacagattagggaccaccccagttgtagactttcttaaaaggattctttatgaattagaaggaagttgaagacaactctttgtctttaataatgaactttcccaaagttgtttctagaagatctgcttaatcaatgcagtttttctttgcacttttctttccttgtagtgtcctgaatttggcaatgattgttcttctgtcttcatgtttgttcctaatgaaaaaatactgtaacattttttattttcttgcggacatactgattttgtgatgtgttcgtttttaccttactaaagatatgtgttttagaagaaatctcattttatttggttggaacacaaattttgtgccaaagtaaatatcttagtatttaatactgtaagcactttgtgtccttccagtccatatgccataattctttcaaactctgggaagaatgctgtggttggaagattattctgttgtatgttactatgaacgcattagtcattttgttgcattacttgtttgcctgtttttggtcactgagtaatcggtgcaagatgctttaactgtttccacaaatggcagtggcatgttgtcacagcatctaaattgttgatagtcttggattgcattaaatgcagcacatttaaaaa

SEQ ID NO: 5787 - DNA, 1367 bp, Homo sapiens
aaatgctgctcagtttgggcttggatggtaacgtttattttccttggcagagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcct

SEQ ID NO: 5788 - DNA, 4027 bp, Homo sapiens
ggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaat

SEQ ID NO: 5789 - DNA, 1305 bp, Homo sapiens
ataatttaatatgagctacgtgtaataaccagcattccattttggacaagggtggtgaagaaaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctctta

SEQ ID NO: 5790 - DNA, 1383 bp, Homo sapiens
gtttccagttggcaagtggacagccttgaacaaaagccccagccctcagcaaagcagacatgatccacattataatttaatatgagctacgtgtaataaccagcattccattttggacaagggtggtgaagaaaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacaga

SEQ ID NO: 5791 - DNA, 2494 bp, Homo sapiens
ggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccacgtattcatcggcctattcctggctttcctgttttggtgtttcggtccattgtggtagaacagaaaccctggccctggatgcccatgttggctgccctggttgcagtaacagccatcgtgctgtacgtgccaggtctggccagagcttctccatga

SEQ ID NO: 5792 - DNA, 2020 bp, Homo sapiens
cgcaggcgcacggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcaggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagat

SEQ ID NO: 5793 - DNA, 1972 bp, Homo sapiens
ggccatcaaaataactaaaccatgtcatttggagcaacaaagccactgcggcctccatttgggccaagctctgactgcaatgatgcctctgccccgacccgggcctcgctgtgactgacaatgccgctgcatcttttcagcagtcattgatgaggaagtatctacatcctccttcccactaccagattttgcttggagaaaagcagtttcctgaaataattctgtgacgagcttcttccacattaggacaaaaatgctggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagat

SEQ ID NO: 5794 - DNA, 1514 bp, Homo sapiens
tttattttatacggactggcggcgagagcagctgcagttcgcatctcaggcagtacctagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatgtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtaaggacattctgctggggccgtgggatatggtgttggcacagggctag

SEQ ID NO: 5795 - DNA, 4026 bp, Homo sapiens
gtattccagaccccattgcagaagcctccgcaactgctccaagaactttattttatacggactggcggcgagagcagctgcagttcgcatctcaggcagtacctagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatggtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgttggggcaccgtgtgtgacgacggctgggacaagaaggacggagacgtggtgtgccgcatgctcggcttccgcggtgtggaggaggtgtaccgcacagctcgattcgggcaaggcactgggaggatctggatggatgacgttgcctgcaagggcacagaggaaaccatcttccgctgcagcttctccaaatggggggtgacaaactgtggacatgccgaagatgccagcgtgacatgcaacagacactgaaagtgggcagagcccaagttcggggtcctgcacagagcacccttcctgcatccctggggtggggcacagctcggggccaccctgaccatgcctcgaccacaccccgtccagcattctcagtcctcacacctgcatcccaggaccgtgggggccggtcgtcatttccctcttgaacatgtgctccgaagtataactctgggacctactgcccgtctctctcttccaccaggttcctgcatgaggagccctgatcaactggatcaccactttgcccagcctctgaacaccatgcaccaggcctcaatatcccagttccctttggccttttagttacaggtgaatgctgagaatgtgtcagagacaagtgcagcagcagcgatggttggtagtatagatcatttactcttcagacaattcccaaacctccattagtccaagagtttctacatcttcctccccagcaagaggcaacgtcaagtgatgaatttcccccctttactctgcctctgctccccatttgctagtttgaggaagtgacatagaggagaagccagctgtaggggcaagagggaaatgcaagtcacctgcaggaatccagctagatttggagaagggaatgaaactaacattgaatgactaccatggcacgctaaatagtatcttgggtgccaaattcatgtatccacttagctgcattggtccagggcatgtcagtctggatacagccttacctccaggtagcacttaactggtccattcacctagactgcaagtaagaagacaaaatgactgagaccgtgtgcccacctgaacttattgtctttacttggcctgagctaaaagcttgggtgcaggacctgtgtaactagaaagttgcctacttcagaacctccagggcgtgagtgcaaggtcaaacatgactggcttccaggccgaccatcaatgtaggaggagagctgatgtggagggtgacatgggggctgcccatgttaaacctgagtccagtgctctggcattgggcagtcacggttaaagccaagtcatgtgtgtctcagctgtttggaggtgatgattttgcatcttccaagcctcttcaggtgtgaatctgtggtcaggaaaacacaagtcctaatggaacccttaggggggaaggaaatgaagattccctataacctctgggggtggggagtaggaataaggggccttgggcctccataaatctgcaatctgcaccctcctcctagagacagggagatcgtgttctgctttttacatgaggagcagaactgggccatacacatgttcaagaactaggggagctacctggtagcaagtgagtgcagacccacctcaccttgggggaatctcaaactcataggcctcagatacacgatcacctgtcatatcaggtgagcactggcctgcttggggagagacctgggcccctccaggtgtaggaacagcaacactcctggctgacaactaagccaatatggccctaggtcattcttgcttccaatatgcttgccactccttaaatgtcctaatgatgagaaactctctttctgaccaattgctatgtttacataacacgcatgtactcatgcatcccttgccagagcccatatatgtatgcatatataaacatagcactttttactacatagctcagcacattgcaaggtttgcatttaagttaaaaaaaaaaaaaaaaaaaaactaaaggtgaaagatgccacattgaacaaactaaattcccaacccggttctggcaaagaatccagttatcccttccatgaagacgcacataactctcttacttggtctttccattagggacaacataagtcttgttttacatcaaataaaaacaatgttaaaaagtgtgtgaaccttaaaaatggaagtctactagtttacatacctacttcagaggacatggaaatgaccatgggcctgcatttcagggaccaaagcaaattaggcctggcctaaaatacatcagaccttttgtaagaaagaatttcaataaagcaaaaaacatgtcacaag

SEQ ID NO: 5796 - DNA, 2934 bp, Homo sapiens
ggcggcgagagcagctgcagttcgcatctcaggcagtacctagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatggtccatgtcacaaacggcgggcaagcatctgctgtacccagctggggtccctgtcggccctgaagcatgctgtcctggggctctacctgctggtcttcctgattcttgtgggcatcttcatcttagcagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgttggggcaccgtgtgtgacgacggctgggacaagaaggacggagacgtggtgtgccgcatgctcggcttccgcggtgtggaggaggtgtaccgcacagctcgattcgggcaaggcactgggaggatctggatggatgacgttgcctgcaagggcacagaggaaaccatcttccgctgcagcttctccaaatggggggtgacaaactgtggacatgccgaagatgccagcgtgacatgcaacagacactgaaagtgggcagagcccaagttcggggtcctgcacagagcacccttcctgcatccctggggtggggcacagctcggggccaccctgaccatgcctcgaccacaccccgtccagcattctcagtcctcacacctgcatcccaggaccgtgggggccggtcgtcatttccctcttgaacatgtgctccgaagtataactctgggacctactgcccgtctctctcttccaccaggttcctgcatgaggagccctgatcaactggatcaccactttgcccagcctctgaacaccatgcaccaggcctcaatatcccagttccctttggccttttagttacaggtgaatgctgagaatgtgtcagagacaagtgcagcagcagcgatggttggtagtatagatcatttactcttcagacaattcccaaacctccattagtccaagagtttctacatcttcctccccagcaagaggcaacgtcaagtgatgaatttcccccctttactctgcctctgctccccatttgctagtttgaggaagtgacatagaggagaagccagctgtaggggcaagagggaaatgcaagtcacctgcaggaatccagctagatttggagaagggaatgaaactaacattgaatgactaccatggcacgctaaatagtatcttgggtgccaaattcatgtatccacttagctgcattggtccagggcatgtcagtctggatacagccttacctccaggtagcacttaactggtccattcacctagactgcaagtaagaagacaaaatgactgagaccgtgtgcccacctgaacttattgtctttacttggcctgagctaaaagcttgggtgcaggacctgtgtaactagaaagttgcctacttcagaacctccagggcgtgagtgcaaggtcaaacatgactggcttccaggccgaccatcaatgtaggaggagagctgatgtggagggtgacatgggggctgcccatgttaaacctgagtccagtgctctggcattgggcagtcacggttaaagccaagtcatgtgtgtctcagctgtttggaggtgatgattttgcatcttccaagcctcttcaggtgtgaatctgtggtcaggaaaacacaagtcctaatggaacccttaggggggaaggaaatgaagattccctataacctctgggggtggggagtaggaataaggggccttgggcctccataaatctgcaatctgcaccctcctcctagagacagggagatcgtgttctgctttttacatgaggagcagaactgggccatacacatgttcaagaactaggggagctacctggtagcaagtgagtgcagacccacctcaccttgggggaatctcaaactcataggcctcagatacacgatcacctgtcatatcaggtgagcactggcctgcttggggagagacctgggcccctccaggtgtaggaacagcaacactcctggctgacaactaagccaatatggccctaggtcattcttgcttccaatatgcttgccactccttaaatgtcctaatgatgagaaactctctttctgaccaattgctatgtttacataacacgcatgtactcatgcatcccttgccagagcccatatatgtatgcatatataaacatagcactttttactacatagctcagcacattgcaaggtttgcatttaagtt

SEQ ID NO: 5797 - DNA, 1074 bp, Homo sapiens
atggagaacaaagctatgtacctacacaccgtcagcgactgtgacaccagctccatctgtgaggattcctttgatggcaggagcctgtccaagctgaacctgtgtgaggatgtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtaaggacattctgctggggccgtgggatatggtgttggcacagggctag

SEQ ID NO: 5798 - DNA, 1945 bp, Homo sapiens
tagaggagctgccggtgcctcctcagaacatctcctgatcgctacccaggaccaggcaccaaggacagggagtcccaggcgcacaccccccattctgggtcccccaggcccagacccccactctgccacaggttgcatcttgacctggtcctcctgcagaagtggcccctgtggtcctgctctgagactcgtccctgggcgcccctgcagcccctttctatgactccatctggatttggctggctgtggggacgcggtccgaggggcggcctggctctcagcgtggtggcagccagctctctggccaccatggcaaatgctgagatctgaggggacaaggctctacagcctcagccaggggcactcagctgttgcagggtgtgatggagaacaaagctatgtacctacacaccgtcagcgactgtgacaccagctccatctgtgaggattcctttgatggcaggagcctgtccaagctgaacctgtgtgaggatggtccatgtcacaaacggcgggcaagcatctgctgtacccagctggggtccctgtcggccctgaagcatgctgtcctggggctctacctgctggtcttcctgattcttgtgggcatcttcatcttagcagtgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtaaggacattctgctggggccgtgggatatggtgttggcacagggctagctgtcccccaagcagccccataagtttggaggttcagaggctggagccatggctggggctcaagtgtcaaaggaggctccctaccttttttagggctctgctggtctagcaagagatgctgatagaccccaggggcactggccacatttctagaggtgtcataaacctggcggttgtgtgcatggatctggaggcttcccccggtcactcgctagcccagctggtataatctctgtgcctcagtgttctcatctataaaatagggataacaggagtctttaccttataaggtcattgtgaaaattgaatgagttaatctgtgtaaagtgcttatgatcatgctggacacctggtgagga

SEQ ID NO: 5799 - DNA, 1607 bp, Homo sapiens
ccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgttacaaacatcttcccttgcgatttcagcaaattgacaaagtttttaacaacattggagcagaccttctgactggcagtgagtccg

SEQ ID NO: 5800 - DNA, 5779 bp, Homo sapiens
gaagaaggaagaggtaagtgaccggccgccggcaccgaccgacctccctcaccggcggctctctcgcctgggctcccggagccggcgaggagggaatggaggactcgcgcccgggttaggcctcccagggccgctcaggctggtgggtgttgcctggtgacgggcctgccggcggccggccgggcgatcggcggtcggcgcccgcgcaaagcggggctggacgagcagcgagctccggggagcggatccgagagggccgagtcctcgaaagaggccttgaggcgacgggagacccgggatcgaagtcagctgccggagggagagccccccatgccggctcgagagctcgggtttcggtggtggagaacgtagtacctttcggggacattggacactactctaggaccgggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccagcaatcatttaaaataaaccatattaagtttagtatgctggtattgtttattcattttatatgaatattcattgaaaatatatacacaatatatgtaatacacagcacttgattacaaaatgtaatttaattatattattgctggcagcattcagttaagagggtactttaaaaaatagaagtcagctttcacatctgatttctgtatgggctgtacttggttaacttgattttagaaaaaggactaacagaattgctaaagaaatgcatccaataaatgaaaaacagtaggaagatcaaatgtttttgtcaaatatattcacaacttgaccagattagctgtcctgtttgtaatgcaatattaatatgtcttttgggaaaaagcctacatatggaataaaataagtattgaagaatttttctttgtaacaatttagtagtcactgtttattgagaaattgttttttattttgtaaaataacatgatgttagtgttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctggtttttgtttgtttttattttggaatgcttataagcctcctttacactgaataaggaagtagtttttgttttcttttgacctgtaaaatacctcacatggttgtttttacacatgaaagaaaaaggtatatgcgaacatacctgatatcaagaggagtatgcaccaaataaattttagctttgataaaactttccata

SEQ ID NO: 5801 - DNA, 2328 bp, Homo sapiens
aggaagtgacgtcatgcccccggccggcaggtcttttagtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaa

SEQ ID NO: 5802 - DNA, 2021 bp, Homo sapiens
agccaagatggcggcggcggcggcagcgacagcagcagcagcagccagtattcgggaaaggcagacaggtactgacttattctcttctccttgaagcttcgtgactgccccgacgacatccttctcctctggcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcag

SEQ ID NO: 5803 - DNA, 1943 bp, Homo sapiens
agtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttcc

SEQ ID NO: 5804 - DNA, 2359 bp, Homo sapiens
aggataaaaactcttagtattcgcctaacattacgggccactgaattaacctgcaccgggtctcccagttctaccgagagtggaggtcttcctggaggaggtggggtccggaactcaggcacaccctttggccccgcccttccgggctttgcttccggggcggtaagggcagccacgtcatccccccgctccgctccccagccgggcagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaataaaatttcaacattgtt

SEQ ID NO: 5805 - DNA, 2016 bp, Homo sapiens
gtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaagccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattg

SEQ ID NO: 5806 - DNA, 2058 bp, Homo sapiens
agtggctcgtgggagccaagatggcggcggcggcggcagcgacagcagcagcagcagccagtattcgggaaaggcagacaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttc

SEQ ID NO: 5807 - DNA, 1656 bp, Homo sapiens
agaaagagacagacagacagaaagtaagcaagcaagcaagcaagcacctcaacagagacagagacgtaaagaaagagagacagagacagaaagaaagaaagcacctcctcagcttcccatagcgcaggagacttgctcgaccagagaacctacggtcagacgacacatccactgccacacccatacccaagccgggacgcggaaccgcttctacccgcccacaccggagaggttgctcgcgattggccgggcgggcacagaggcccgccttccgaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaa

SEQ ID NO: 5808 - DNA, 1223 bp, Homo sapiens
cagtgtgagcccgacccgagctccagtagttccgcccgctggtcatcgcgccctttcccctgccggtgtcctgctcgccgtccccgccatgctgtctctagactttttggacgatgtgcggcggatgaacaagcggcaggtacaatgagagaaatgcaaagatagttaagaaagactcggccttcaaggagcctaaatgtgtagaaaaggactaaggcaaaacaataacttttttgagctcttgccatgtgtgaagcactttatacacctgtaagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaa

SEQ ID NO: 5809 - DNA, 824 bp, Homo sapiens
ggacgctgggccggtgggcgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaagatg

SEQ ID NO: 5810 - DNA, 1170 bp, Homo sapiens
agccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtgaggattcacctttaagttatatagaaggttatgaaaaacacttagaaatgaagaaattaaatcaataggctaatgagtcgttaattacaaatatgacatatcaggagagttttaagcagttctagtttatcctgtgaagactaaatacaacttagaaattcctaaagacctaaaatctaaaactgaacccaattatattatctatatgatgggttcaaatctgtttcaaaataaatccagccaggcgcagtggctcacacctgtaatcccagcacctttgggaggctgaggcaggaggatcacttgagcccaggagttccagaccagcctgagtaacatagggataccccatctctattaataaaaattttaaaaaatttgttctaaaaaaagaagaaatataaatcctcactgagagattagttatttgtggattttaaataaccattacaagaaagtctcccagagataaccactgtttaacatttcagggaatgctgtaggtactctctgggctggtacagatgtgtgttatgcatatatataattttacttagaatttgattatttttcacccaacaggaagttggaaatagcttttcgtgtcaaatctacatctgtatctttttaagtggctacaagctgt

SEQ ID NO: 5811 - DNA, 1202 bp, Homo sapiens
ctttcctcgctgcagtcatccaatagccaagatacacggctaggtgatttgcgagcgggagttaggtgtcctcttggcgcctgaccagagtcgggaaattcagctcctcttgagtagtcccttccccgagttgccccccgaggtatgcggggtcactcgctgctcgatgttccctccgaagggtcggacaaggctccggagccctgtagctgccctccctaggagccccgggtcttcactggccgaggtgcccaccccgcagcattctgggagtggtagttttcttccttcaggttcattcctggctggccagtgcccaagactggcgagactacgattcccagacgcccaagcgagtcgccggtcacgtggccgcaaggacgctgggccggtgggcgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaagatg

SEQ ID NO: 5812 - DNA, 10551 bp, Homo sapiens
cccgggcgcgcgcggggtcgcgcggacgcggctcgggccgcgggtgccgagaggtcgccgggccacccgcacccccgctccccgcctgacgcacggaggggccgggacgcgatttgccgcgagtgactggagccgcagccgtcgccgctgctgccgccgccgcccgggcccgctccgcccccagcccgccttcctcccgccgcgccctccgcctccgcccgcacctcgctagcgttcccctgtcttccccaacgccccggagccgccggccgctagcgtcagcgccagccagaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggtgggagtctcacctatgatcacatggactggttaaataagaggctggtttttgagaagtttacaaaggaatctacatcattattagatgaacttgctttgattaacaatggaagtgataaaggaaatcagcaagagaaagaaaggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatttgtctcagcagttggatggcttattagggatgttgtgcgtagatgtagcaccagctgatggagcatcgattcagcaaactttaaaactgcttgaagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccaggcagtagaatggctaagtgaacttctggatgctctgcttaagactcacatcagattgggcgatgatgctcaagaaacgaaagttttgctggaaaagcatagaaaatttgttgatgttgcacagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaagacttctttaaacatcttatttaatttagtagttacatcctatttccaaacatgagtgccttatttaaaagggcattcttaggactgtgaggatggtttaatatttgttttttcatggtggttgcatgtattttagacaggaaatacatatgtaagcatgtgtatataataaataagcatgttttatcatgaaaaattattgtgaacaatttagatctttaagaacttattaataatggaatactatttctaatttttctctttttcaacttgaaaaatattctcaaaattattaactaccctgaagatactttgtctttaggggaggagggctgaggaagaaggcatacataattacttcagtgtaatcctttatatcagagtaatctttcaggaactaaaatagcaattgttaataaaatttagtttctcattatagtctaaaagcaaaataaattctgaagtagtccaataacagaactgtatgacccctttagaaataaaatttatcatgaaatgctagttcttttaagtttgtattaagtttaaatggtaaaatgcatataatttaaattttatgtatttttatttcagaacattttttaaaatattaaaaattattttttagtcttgtagtcattacaaaattataaacgagttgtatactggttcctttttgaggtctacaaacatgctcgtgtatcttccaatgcaaaaaaaaaacccctcccttttaacctgctagtttttccagccttcttcactgactgacagacttcttggagaaatccacatccagtgcccctacatcctcatcactcactactcagcaccttgcagtctggttttacacagcactctactgaaactgttcttttgaaagtcagcaatggcctcccagttaccaaactgaatggtttttttctccgtctgaatcccttacccttttctctgcaacatttacaccattgagcaacctttcctagacagtgtctccttccttgaagatgctatcctctgaaataactgtgagtacagtcgcataaccctaatttaagatgtgcctgctgaacatgtgctctctcagatcctgtcctcagaatgcttttggctcttttctcggtatctcatccttagagtttttattttataccaatgttctggattacatacctggtccagaaatctagacttgtacttctttttaattgcctagttgacatttcaaccttgattaaagattgacaatatttatcaccttttcctcctggaacaatttaggttaatggtgcagccttttttcctagtcaaacatgccaggaagttcagggcaaagttcaactgctccctcttgtcttatgtggtcactgcttctgagaacatccaggaagttctttctatacttgaatcatcttctcagtcctttggggctttactgctatgagtatgaacttttgtgattatttatttcagtcttcatgatggtgctatcacattctacagttgtttatgtctgtacccagtaagctcttttgagggaaggaatcttgtcttctcctattcccagtcttgctcatgcataacagatgcccattcctcctaaatatgaatgctgtattataggcattagtaataatccctgttacattgcagtctgaagtatgttttaaacatacttttttaaagttagaactgacttacaagtgaatctattcttagattcttagatactaactactttagatatttagttatactcaataactaaatatcaatactcaatatctgtttcttctgaatttcagagtagttagaatgtttttcttaagactttgctagaaaggaactggtttgttagtaattctgccatcaactcatggagttataattgccaaatgagttaatttttatataccttaagctatcttgcctacaaaaagtaaaataaggcaggattcataaatgttacttgtaaattgagtgtttcacatgaggccaagtatgattttaacataatgaatatcattgctcctcatctgtaaatttgctgctgctttcatatgtgtatctgtacatagagttatgaatgaaaatccagtaatgccctaaagcaactttcttccatagggtcaaagctcacttaaggtaaacgtgtgaaaaaagtgactgcagtgtgtttgaaaccacaagctgtttctatgtcataaattaacatcagcttgcaagtctctgaaagaaccactcatttgtaattggtatatatgtcacaacctcccacattcctttagcccatctcagggaattattgaaacgctggcagggttagtttcattttgttttggtttttttgggtttttttgtttgtttgaggattttttttttcttttatcatttgtttgctcctgtgtaagcttaatatataatggcagtttggcatctgttcttcgcacatgtctaacccagcagagttatgcaaaaatgatgacttcattttaggtcaaattggctttgttcccagtcctcattgttggtcactttgttcagttctggtgactcattggtgatgttgatgaaactgctcagcctgccagctgggatattgatggcaggtctaggcttcattgttaggtagaagattgaatacttctcactttatacaaatttacattggctattgctcccatgtgttagctagtcttaacatgtttgttatttcgttatcttattagctgacatacggagtggtattattagtgtcgtactccttagcgtgagcatgacaattaagttaccttactaacagtgatgagtaaaccatactctgatctaaacccattgttaccaatgatgtgattatgaagttagctgaatctatggtctacatttgaagaaatagttcagaattctctactacattgtaagttacttgctaatagagattgggcattattatgtactactccccttctcacatcctacccaaagtacacaaggccgtagtaaaatactgttgctactaaaaactaaacatactgtggttgctaatgtcctttacatcttcagcctatagggaatggtacaggcagaaacaagcaccattaagtatattatcatcagtagtgagatctgtatgattaggatatctttgcttaagcccccaaaggaaaaattctctagcattaaaaacatggctggaacatagctaagcagttaacctaattagtagacttattgttaacgttcagtcctaaaaatgaaaagcttcagttgggagtagaaaatatactatgctggtatatagagcaacaaataccctgatgagataaaatgaagtagaaacttaccatttgacattatttgactttcatacatgctactgaaaagtctaggtttagctaagaagcataaataatggcagtacttgtagaggaaagaacataccagctaaaacaagaactgtaatgaatataatggaaagtgtttggagcttgaatacttggcttcaaaaatctggctttgccatttactgttaaaaaaatatctgagaatttatctcaggctgtaaaacagagaagtcataccaatttcaagaataaaatatgatataaagaattgttgaagccaaaatatccagaaataaacagaatggaaggtatcattgctataattatcttttcagaataaaaaatagagtattctttatcctttctgttgtctcacatgacaagcatgggatggtgaggaaatggcatattgcctatgttcgccgccccacccccttagttccaccaccccttcaccgtcacccccagttcactagtgtatcagaatgcatcttcagaattacacactgaagatacaaaaggtccagttggtaagctcatcagtaaataacaaggctttgaaatctgacaaattagctatttttgtaggaagataatagaacagcaagatggaagacaagtgatgagtatcatctgttttgaggttgacaaggtgtgacataaccctgttaatagacacaagtaaaagaaaatcatactaggattggatattagtgagcgagcaccgaccagtagaaacaacaacagcataaatctgttatttaagtatcccaataatgaggttaaaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatctttatggccaacagatttgctcagaatatatcatcaaaatatatgtattgtattttgtaaaggtgaaaggatcgaaataccactttgacagttataaaccagagtagatttgagaactgattgctcacatcacacttacgaatagtctcagaagcctttaagagaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaaataacacaatcatatcatgctataaacaatagcagttccagaatggctactaaggattttggactgccagactttggaaattggcaagccttataccttgtccaatgaagttaagtacatttgagtgacagttcaacatacaagcaaaaaaatatatagaagacattgtacatttgttattaatggacatgtttactttacatgttagagtatccatccatctctaggttttccattagatgcttcattgtatccacaaacctgt

SEQ ID NO: 5813 - DNA, 681 bp, Homo sapiens
ggcccgcagagaccgggccgcgcgcttttccgttcctgagcgcccttgttcatttctgggtgaaagggacccgaattgtgcaacaggtttgggcgttagtccttattttccagcgggtctcttttgccagcgtgcaggaaccagatgtggctccctgctctcgggcgagtcccgcgtccagcgcccgcgactggctcctttgtgtgaccggtgaccggccctgtcggaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaa

SEQ ID NO: 5814 - DNA, 619 bp, Homo sapiens
agacaaagcgccggaggtgggagccctgcgggccgcctttgcctccgcgccgtctgccgggtgcggccgcggcccgcagagaccgggccgcgcgcttttccgttcctgagcgcccttgttcatttctgggtgaaagggacccgaattgtgcaacagaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggt

SEQ ID NO: 5815 - DNA, 2957 bp, Homo sapiens
actcgcagtccgcaggatgactcagggcagccctgaccacagttccgccgccatcggccctagcctgcggaattgggctcgccccgggacgataacagagctctgccgggggctggaggcactgaccgggtgaccagagacccagagaccagaccccctccacggcgcccgggatttcggggacggcttctcccatcgcaagtttcaacagaaaatgagaaatatcccccgacgattggctgaaaacatgcagcaaccactattttcttcctgcccctcgttgatgagagcattcgaagtgacctcagcagggcatccaggtcagtttctggaagacttgtgtgtgtgatgaatgaatatctggttttgtctctgctgggcctgtgtgcctggaaaggaattgttttggcctaggatcatccagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactcccc

SEQ ID NO: 5816 - DNA, 5437 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtcctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcagggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttcgtaggtagggttcgtaggtagggctggtaggtagggttagtaggtagggctagtaggtagggttagtaggtagggttcgtaggtagggttcgtaggtagggttcgtaggtagggctagtaggtagggttagtaggtagggttcgtaggtagggctagtaggtagggttagtaggtagggctagtaggtagggctagtaggtagggttagtaggtagggctagtaggtagggttcgtaggtagggttagtaggtagggctagtaggtagggttcgtaggtagggttcgtaggtagggctagtaggtagggttagtaggtagggctagtaggtagggctagtaggtagggttcgtaggtagggttcgtaggtagggttcgtaggtagggttcgtaggtagggttagtaggtagggttcgtaggtagggctagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactatttaaag

SEQ ID NO: 5817 - DNA, 5493 bp, Homo sapiens
gtcacccgtaacaaccacaagtgccgtcgccgcgccccttccccctcccgcctccccggccccctccccggaaccggcggtcgagctacggtcgcggagcagtggaaccgagactgccccgcggagccgccgctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtcctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcagggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttcgtaggtagggttcgtaggtagggctggtaggtagggttagtaggtagggctagtaggtagggttagtaggtagggttcgtaggtagggttcgtaggtagggttcgtaggtagggctagtaggtagggttagtaggtagggttcgtaggtagggttcgtaggtagggttaggtagggttcgtaggtagggttagtaggtagggctagtaggtagggttcgtaggtagggttcgtaggtagggctagtaggtagggttagtaggtagggctagtaggtagggctagtaggtagggttagtaggtagggctagtaggtagggttcgtaggtagggttagtaggtagggctagtaggtagggttcgtaggtagggttcgtaggtagggctagtaggtagggttagtaggtagggctagtaggtagggctagtaggtagggttcgtaggtagggttcgtaggtagggttcgtaggtagggttcgtaggtagggttagtaggtagggttcgtaggtagggctagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactatttaaagaaaa

SEQ ID NO: 5818 - DNA, 5334 bp, Homo sapiens
agtgcatttggtggcagagtgacaggcttggaagagaatgtggagggagtaagggaggcgcttgctaactgcccctgacgctgacagagctctggagaggtcagtgcagcttctgagttagctgctccttagcctggataccttaaatgccatctggttgggcatgccaaggcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtcctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcagggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttcgtaggtagggttcgtaggtagggctggtaggtagggttagtaggtagggctagtaggtagggttagtaggtagggttcgtaggtagggttcgtaggtagggttcgtaggtagggctagtaggtagggttagtaggtagggttcgtaggtagggttcgtaggtagggttaggtagggttcgtaggtagggttagtaggtagggctagtaggtagggttcgtaggtagggttcgtaggtagggctagtaggtagggttagtaggtagggctagtaggtagggctagtaggtagggttagtaggtagggctagtaggtagggttcgtaggtagggttagtaggtagggctagtaggtagggttcgtaggtagggttcgtaggtagggctagtaggtagggttagtaggtagggctagtaggtagggctagtaggtagggttcgtaggtagggttcgtaggtagggttcgtaggtagggttcgtaggtagggttagtaggtagggttcgtaggtagggctagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactatttaaagaaaa

SEQ ID NO: 5819 - DNA, 5546 bp, Homo sapiens
gtcacccgtaacaaccacaagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtcctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcagggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttcgtaggtagggttcgtaggtagggctggtaggtagggttagtaggtagggctagtaggtagggttagtaggtagggttcgtaggtagggttcgtaggtagggttcgtaggtagggctagtaggtagggttagtaggtagggttcgtaggtagggttcgtaggtagggttaggtagggttcgtaggtagggttagtaggtagggctagtaggtagggttcgtaggtagggttcgtaggtagggctagtaggtagggttagtaggtagggctagtaggtagggctagtaggtagggttagtaggtagggctagtaggtagggttcgtaggtagggttagtaggtagggctagtaggtagggttcgtaggtagggttcgtaggtagggctagtaggtagggttagtaggtagggctagtaggtagggctagtaggtagggttcgtaggtagggttcgtaggtagggttcgtaggtagggttcgtaggtagggttagtaggtagggttcgtaggtagggctagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactatttaaagaaaa

SEQ ID NO: 5820 - DNA, 3009 bp, Homo sapiens
gtcacccgtaacaaccacaagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgacctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactattt

SEQ ID NO: 5821 - DNA, 6456 bp, Homo sapiens
gggtcctggagctctctcggcccggcaggtttcgctcccgcccctccggccttccacagctgtcctggccgcagggtgttcaaggcgggacacaccaggctagagatccgcgatcgggccccgcctcaggctctgtgcacacccctgcctggtgacctccattggtgctccagcgtgaacatggtgcaaagataccagtctcctgtccgagtctacaagtacccgtttgagctggtcatggcggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtccaccctgagaatgaagactggacttgcttcgagcagtctgcctcactggacattcggtctttctttggctttgaaaatgccttggagaagatcgccatgaagcagtacaccgccaacgtcaagagggggaaggaggtgattgagcattacctgaatgagctcatctcccagggtacctcgcacattccgcgctggacgcctgccccagtccgtgaggaggatgcccgcaaccaggctggaccgagggaccccagctccctggaggcccacgggccccgtagcaccctggggcccgctctggaggcggtcagtatggacggggacaagctggatgcggactacattgagaggtgcctgggccacctcacgcccatgcaggagagctgcctgatccagcttcggcactggttacaggagacccacaaaggcaagattcccaaagatgagcacatccttcggttcctgcgggctcatgacttccacctggacaaggcccgggaaatgctgcgccagtccttgagctggcgcaagcagcaccaggtggatctcctccttcagacctggcaaccccctgccctgctggaggagttctatgcagggggctggcattaccaggacatagatggccgccccctctacatcctccgcctgggccagatggacaccaaaggcttgatgaaggccgtgggggaggaggcgctgctgcggcatgttctctccgtcaacgaggaaggacagaagcggtgtgaggggagcacaaggcagctgggccgtcccatcagctcctggacctgcctgctagacctggagggactcaacatgcggcacctgtggcggccgggggtgaaggccctgctgcggatgattgaggtggttgaggacaattacccagagaccctgggtcggctgctcatcgtgcgagccccccgagtcttccccgtgctctggacactgatcagccccttcatcaatgagaacaccaggcggaagttcctcatctacagtggcagcaactaccagggacccggaggccttgtggactatctggatagagaagtgatccctgacttccttgggggagagagtgtgtgtaatgtccccgaaggagggctggtccccaagtccctctacatgacagaagaggagcaggagcacacggaccagctgtggcagtggagtgagacctaccattcagccagcgtgctccgcggagccccccacgaggtggccgtggagatcctggaaggagagtcggtcatcacctgggactttgacatcctgcgaggggacgtggtgttcagcctgtaccacaccaagcaggcgcccaggctgggcgcccgggaaccggggaccagggccagcgggcagctgatcgacaaaggctgggtcctgggcagggattacagccgtgtggaggctccccttgtctgccgggagggggagagcatccagggctcccatgtgacccggtggcccggcgtctacctgctccagtggcaaatgcacagcccccccagcagcgtggcctgcagcctcccgggtgtggacgatgtcctgacggctctgcacagccccgggcccaagtgcaaacttctctactactgtgaggtgctcgcctctgaggacttcaggggctccatgtccagcctggaatcctgcaccagcggcttctcccagctcagcgccgccacctcgtcctcctcctccggccagtctcatagcagctccctggtctccagatagccgggcccagtgtttcagggccgcccgctcgcctccagtgtccagaaatgtccagaatgagaagccagctaactgcagggcctgggaccatgtgggctggagccccaggcctagatgctgcccaagttggggtgtctggagcggatggcaaggatccagaactggcctgtgggtggtgtcagggctcttgaaattgcaaggacagaaccatctccttccggcttcgtgtaaggaagaccaagccaaggccaaggtgtctaccataccacacctttgggacatccgggcttagcgacgtcagccaggcccatctcctctctgtccacctcttgctctgctttcgccatgcaggggaccatcactatcaggtgcccttctcctccctgcagcttgcctgcataagagagcctcttcctcccaaaggctccagcccacttcccagagctgagtcttagcctggaagggggagcgattgccaggtcaattcctgaaccaatcacagttgccaggcacactggagaatgctgattggccagcagggtcatgcccaatctggaccaatcaccgtgatccagggttgcagtgaggtgcagtgattggccagcctggatcacatgcacatctctggaaccaaccacctgctctcaaaagcactagtgggtgcctcgaggagtactggggtcccccctaagaagaaggaggaaggatgctggggaggcagaaatgaagggtgtttaccttggcatctgattgcataacgttctgttatgcagtatcaagatgtgcttggtgagcagttaagtgagttacaggcgctgctctttgtggggaacagcacatcctgaagtgaaaatccatgttccctgcacttggccagcatggcctaagcctgaccatccctgattggagagggtgggagagccctgggtttctgctaagttccaggcagtgatggggtgactgaggctgtctgtataccccactggagatgcctttctctcctagggaactgtttaattatgactgtttttggttgtaagccacagagacccatgcccaggtgcttcaacacaaaagcatgatcattcatgggtgcatagaactggccagtccaggagggcttgcttcaggtaaggctagatccagggtctcaacatggagtctcgattccccccgcgagtggaggctgctgtgtttgccctggggcagatatgactctggaactaggttcaatattgacatgagttcccctagttactacacaggagcgtcttgggtctccttggggcctgaggacatttctcctttcctttcctggactccccaaaaggcagccagtcaggggtcaccaacttgaagcctgatctggcctgcttttagtgttgcttttttgcctttagaatggtttaaaaattgaggcatttcgcatcgaaatcaggatttctggcttcccttaggcatttgggagcaccagcagaatggggtcactattgttgcatgaagacaacacctctgcacccctggatgtggccacgccagtccctaccccattgacttgcgcccagcccacattacacatcctcatgacctgcgtggcaggagtctcactgacatggctctgtcagcagtggctggtacccttgtctcctggccttgcttagagttggggctcatctctgctgcagtaactgagccaaggggtggttttgtggccacaagaatcatctttatgcaggctcagcaatgcagggccaggaaacttatatctacgccagcctcaaccccaaacccaaggaagagagaaagtgtcatcttttcagatacatccttcttcctgctgggagagagccttgcccaccttcctgttggctctctgtccgcttctcaggtatctgaacaaaatagattgctttgcactctgcgtcaaggtgtgtgtgcacatgtgtgcataagagaccgactgattggaaggagacgttctcaaaactaattgctcccatatcaccaggcatttattgctgagagcaacttgcaatattttcaactatctttaagtgaatttctagcttttctcttaaaaactaggtgttatcctacaagtatgctgggataagctgccctggcagtctttatacatttattgtctagccccagagaaggacacagaagccttttacggaaggaagctggaactgcctgttccagaggcgggtggggggaggggagtctgctatcagctgtccacccttaacagtgggggtgaggaacctcaggccctttcagttctgctcttgagagtgctctctccctagggaaaaccagcccaaactggcttaagcaacaaagcaaattccctgggtcctgtactagggatggctgaaggtgggtgctgcttcagatatggctggatccaggagcttaatgtcctcaggcctctcaactgcacccaggcctcttgactctgcatctctttgcatgctgacctcattctttcttccacctggcgggaaagatggctgccagcagccccaagcctataatttcaggattcacactctaagagatgcttttccatctcaaatctcatggaaggctctgattggcccagctcgagtcacatgcttattcctgtgggccacactggcaaggaactagggtcccgtgattgacattccctgcagaagccgcagcaggattggggagggccattcccccaatggacaagagaagctggaccacagaaccagcaggtatccatggtggcatctgctacggccggctctcctcccatgtggaggtctcggggacccacgtggaagcattatcaaggtcattcttcttgccttcgggaggactggaattaaaaataatccaaggaagggattgccaagcttttggcttttgaatttcccctgagccacaaaggctggaagtgccttggcttgggcttcttgcatcattagttcattaatccattgtgaccaggacagaagcaacccacaagcagcattactgttggtgtttgggcacctgggccttgaatttaggccaggactcaaaccccagccttcctttcactagctgtgtaaccttgaccaggtgacttaacctctctgtgcctcagtttcctcatctgtaaagtgaggatagcagtgcctacctcaataggttgtagtgggacgaaatgagggagtagctgtaaagctttcagcacagctcccagaacacagaaagcgctccattaatgtcagtggtcattctgattacttaatgcttcgcatccaaagactcgttttcttcctgaggtcgcctatccctgtttttcgttattgcacccagagaaaagtaggtgtcaagaattattgccctctgagttgggtgtgcagtctttctcttttagaaactgcttgtgtgggcggggcgtggtggctcatgcctataatcccaacactttgggaggctgaggccggctgatcgcttgagtgcaggagttcaagaccagcctgggcaacatagtgagaccctgtctctacaaaaaattaaaaaatgagccaggcgtggtggtgcgtgcctatagtctcagctgctcgggaggctgaggcagaaggattgcttggaggtcaaggctggagtgagccatgatctcacccctgtacttcatcctgggtgacaaagcaagaccctgtctcaaaaaaagaagaaagaagctgcttgtgttttctgggtaagtccacccatctgagggagtgtattctgagtggtatttcccttggcagttagaaaatgttttttcccagaggttgaagtatggagagtttgagactctttttttctaccctgcactctctggaattccccctccctgctgtaaaatttattgtccaatgagaatagtataattgttttcaacaaagtctctttgagccagtgaaacacgatgggtttttttgtttgcctgatcacttgctccaaccagcagcattaaatgttttccatttggataaacttgcatcgtcagcttcctaaaaccctggaggtttcccgtgggctcgttcaagaactttccagctgttgtttaaaagactttagagctagcttgttcagcctgtggcctgcaggctgcacgcggccccggactgctttgaatgtgctccaacacgagttcgtaaactttcttaaaatact

SEQ ID NO: 5822 - DNA, 1380 bp, Homo sapiens
ctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccagtgttatttgtacctgttctacagtccagccaggactatgaaggtggtgcttatgctgctctttatttgcctgggcaacatgtacctgcacgggctgaggaacctctggcaaatccttttccacataggagtggcttttctgtcttcatatcagatactaacaaggcagcttcaggagaagcagtctgactgtggagtatgaggatgacactgtgatgaatggattctttgattttcttttgaggatcaatctatgtttctctttctgcttctctactttacactccagtttccatccttttcagccaactggactgaaaaaccaggaattggggatgttaaacagttgcagtggaagtcatgaggttgcttgatacccagccttggttctgtgccaagcattactgcaggatctccagccagttcagcacgtttacctaggacagctggatctgggggctcatccagaaagagctttattggaagagagaaaggaaatattttggtcttttaagttgaatgatac

SEQ ID NO: 5823 - DNA, 1608 bp, Homo sapiens
agcagcagcgaatgcggggtaggggggaggtggggtggctcaagactcgcgcacgcgcaccacggcctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttatt

SEQ ID NO: 5824 - DNA, 1513 bp, Homo sapiens
ccagtttccagctcacccggctcccggttgatctcgatgtcgaagtggcactgcggccggtcctgcgcccccatcgcgaccgaggtggcggcaagagctgggagagagggggagaaaagcggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggctt

SEQ ID NO: 5825 - DNA, 1458 bp, Homo sapiens
ggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 5826 - DNA, 1446 bp, Homo sapiens
ctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaacattttaaaggaagcggaagaaagacagtctcaggaataggtcgaactgaagagacaatatacctgcagcaaacagctacaggactgtttaaagccaagcaagtgcagaattcagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcg

SEQ ID NO: 5827 - DNA, 2700 bp, Homo sapiens
ctgccgccttctagccgggcgttcgcggccccgccggcccgactctcaagcctcagctcccaggctaggctgtggccgccggtggcctggggagagtgcggcgccatgcctcgggcttaatgcgcccccccctcttctcccagtcttcagtcttaagtcgttagcctcctccctccgctttcagcagtggtctttcagctctcttcttgtgcgctgttgtcgaccccgaccagccccttccaacccagtcatcatgtcccagccgggaataccggcctccggcggcgccccagccagcctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgaatccagtctctggacagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagagtgtcattggggtcagttcagaagaaactcttattacctgcctggaaattgccatgagataatacagtgagaggtgaacagaatgtgtctgaaggggggatgttgtctaccctgtacatgcatatatgccgtaggggtaacattttaactagcaagtctatggtctctgctgttggcaatggtgactgtgccatagtgcgaagtatttttttccccattaactctatttgtacaacctaacctgtaaaggtagttgtttttcttttgtagtgatattactagttggcaaagttactggatatcttagatttgcaacagggaagagctaaactcgctttggaacttacaagaataaagtatgtagaggtgatggagaaggccatatttcatggcattaaaatacatcaaatctctaaactgtgatggttcttttggatacattttggacttatagtcttgctggactactgcatgtgcaagaactgtaaggcccaactttgatttgtcttgcttgccaatttataatgttgacttaaaatggctttcttgtcatttgaccaacttcattgtttagtgtctgtagattctctgaccatcatcatgactcaatgtcttgtctattgtatgagatactgacttaatgtgaaataaaattttaattatgaca

SEQ ID NO: 5828 - DNA, 6299 bp, Homo sapiens
ccggccagggcctccctccttctctctaggtttggctgccgccttctagccgggcgttcgcggccccgccggcccgactctcaagcctcagctcccaggctaggctgtggccgccggtggcctggggagagtgcggcgccatgcctcgggcttaatgcgcccccccctcttctcccagtcttcagtcttaagtcgttagcctcctccctccgctttcagcagtggtctttcagctctcttcttgtgcgctgttgtcgaccccgaccagccccttccaacccagtcatcatgtcccagccgggaataccggcctccggcggcgccccagccagcctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgaatccagtctctggacagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaa

SEQ ID NO: 5829 - DNA, 4643 bp, Homo sapiens
cccttccctccgcccacctccctgaagcggagccgccgtcgccaccagcgccgtcatgtcggcccccgccgggtcctctcacccggccgccagcgcccggatcccgcccaagttcggcggagcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggcgtgcagtatggtgaatatgttaataaccaagctagctccgcaccaactcccttgtcatcaacttccgatgatgaggaagaggaggaggaggatgaggaagcaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaacagtatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtgagaaatttgaaatgaaggcatttgttaatacaagatgcaacgcacagcactctgtctgaggctttggtaaaaagtaaaggggaagaaagaacttgacagatctttttcaactcaaattaatggtaacgatgatgctgtttcaccaagtatattttgaattggtttctacacatttccagtagtatggcagtacagtgctctgttcattgcaagctggcaaatttatgtagctatgtggaatgatatgtcataatgtaaaattagataaattcttttttcttataattaatataacatttctggacttgaactctggcaagagatgccaaaaggcattggtaccgtgttatttgtttatatgaattactttttaacaaggaatgtttcttattcattaaatgaattcaacattttctctgtaaaaacaatagagtttcagtacatgaactatagaaaaaaatctatatataatgtacataaatgttacatttgtaaagaaaatgtaaaaatgtaactatagcatatgaattgcttaaactgtgctgcattgttggatgacaactctttttgtcacagttagagaatgaggttgactaatgcatattatgaattgagtccacaaaggaacacaaaactctttgtaattctgttaaatcttttatgtagatttatttatgatcagcctactaattaaaactatttcgcttgaca

SEQ ID NO: 5830 - DNA, 3780 bp, Homo sapiens
ttcccttccctccgcccacctccctgaagcggagccgccgtcgccaccagcgccgtcatgtcggcccccgccgggtcctctcacccggccgccagcgcccggatcccgcccaagttcggcggagcggccgtctcaggagccgcagcgcccgcgggcccgggtgcgggcccggcgccgcaccagcagaacggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaacagtatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataag

SEQ ID NO: 5831 - DNA, 4066 bp, Homo sapiens
ggcgcgttccttcctcttcctctctcctctccggccccgccttcccttccctccgcccacctccctgaagcggagccgccgtcgccaccagcgccgtcatgtcggcccccgccgggtcctctcacccggccgccagcgcccggatcccgcccaagttcggcggagcggccgtctcaggagccgcagcgcccgcgggcccgggtgcgggcccggcgccgcaccagcagaacgagacgggatttcaccatgttgcccaagctagtcttgaactcctggacccaagcaatctgcccgcctcggcctcccaaattgctgggagtacaggtccagcccagaatcaaatgcaggttccatctggatatggattgcatcatcaaaactatattgctccctcaggacattactctcaaggacctgggaaaatgacctcattgccattggatacccagtgtggtgattactactctgctctctatacagtaccaacacaaaatgtgactcctaacacagtgaaccagcaaccaggagcacagcagttgtacagcaggggtcctcctgcccctcatattgtgggatccactctaggatctttccaaggtgctgcatcgtcagcatcccatttgcatacgagtgcctcccaaccatactcctcttttgtgaatcactacaatagtccagccatgtactctgccagctcttctgttgcgtctcagggatttccctctacttgtggtcattatgctatgtcaactgtttctaatgccgcgtatcctagtgtttcatatccctctctgcctgctggtgatacatatgggcaaatgtttacctcacagaatgctccgactgttaggccagttaaagataattcattctctggtcaaaatacagctatcagccatccatcgccacttccacctctaccatcacaacagcaccaccagcagcaaagtctttcaggatacagtactctaacgtggtcatctccaggccttccatcgactcaagacaatctcatccgaaaccacacaggatccctggctgtagcgaacaacaacccaaccattactgttgcagattctttatcctgtcctgttatgcaaaatgttcagcctcccaagtccagcccagtggtatccactgttttatcaggatcctcaggatcctcatcaacaagaacacctcccactgcaaatcacccagttgagcctgtgacctcagttacacagccatcagagctattacaacaaaaaggcgtgcagtatggtgaatatgttaataaccaagctagctccgcaccaactcccttgtcatcaacttccgatgatgaggaagaggaggaggaggatgaggaagcaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagccttttggctatggctatccaacacttcagcctggttatcagaatgctacagcaccacttatttctggagtacagcccagtaacccggtatattctggattccagcagtatcctcaatatcctggtgtgaaccagctatcctccagtataggaggattgagtcttcagagttctccacaaccagaaagcctgagacctgtaaaccttactcaggagaggaatattttacctatgactcctgtttgggctcctgtacctaacttgaatgcagacctcaaaaaattaaactgtagcccagattcatttcggtgtactttgacaaatattccacagacacaggctttactgaataaagctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttgattgtgtctgatatagatgatgtttttctacctacaccggatagtttacttgtgaatctatatgaaagtaaagagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtggtacaacatcttggccctgcaactgatttttataagaaacttgcattagattgctcgggacagcaaactgcagtggatttgttccttttaagttcacagtattctgatcttgcttctctagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtctttcaatgcacacttttcacggtaacttctttgtccgttctactgatttgttatcccttgccaacatcaatcctgatgctggatttgcggtgcagttgtcaattgaagaaagtttaacagatacttccttagtatgttttcaaacagccctattatatacatcaagcaaaggtgagcggagaattagagtacatacactttgtttgccagtggtaagttcactagcagatgtatatgcgggagtggatgtacaagctgccatctgccttctggcaaacatggctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacagaaagcatttagaacgggtacaagcacacggctggatgatcgtgtatatgccatgtgtcagataaagtctcagccacttgttcatctaatgaaaatgattcatcccaacttatacaggatagacagattgacagatgagggtgcagtacatgttaatgacaggattgtaccacagccacctcttcaaaaattgtctgcagagaagctgacaagagaaggtgctttccttatggactgtggctctgttttttacatttgggttgggaaaggctgtgacaataacttcatagaggatgtgcttggatatactaattttgcatcaataccacagaaaatgacacatcttccagagctagatacactttcatcagaaagagccagatccttcataacttggcttagagacagcagaccattaagtccaatccttcacatagtaaaagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtga

SEQ ID NO: 5832 - DNA, 4513 bp, Homo sapiens
gggagccttgacgttaggaacgaagtctaacctggatctggagccgggagataatctgaatgctggctggggcagaaaattactaagatcctgtggaagtgtgaggattattaaactgatcactgtctgataaggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 5833 - DNA, 4433 bp, Homo sapiens
ggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 5834 - DNA, 3424 bp, Homo sapiens
gacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctcaactcagtgagctgcctcctcagcagaaaaccaggcacagaatagaccccgatgccattcctagtccaattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacacct

SEQ ID NO: 5835 - DNA, 1430 bp, Homo sapiens
cggccccctcggaaccggaagtggagcctgggagccttgacgttaggaacgaagtctaacctggatctggagccgggagataatctgaatgctggctggggcagaaaattactaagatcctgtggaagtgtgaggattattaaactgatcactgtctgataaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctg

SEQ ID NO: 5836 - DNA, 1440 bp, Homo sapiens
gagcctgggagccttgacgttaggaacgaagtctaacctggatctggagccgggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattg

SEQ ID NO: 5837 - DNA, 4030 bp, Homo sapiens
agccgagaaagggtttgacgtggcagttcccagcccagctgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctta

SEQ ID NO: 5838 - DNA, 4065 bp, Homo sapiens
gcggctggtccaagcccggcgctgggggcgcgcagccgagaaagggtttgacgtggcagttcccagcccagctgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggcagccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctt

SEQ ID NO: 5839 - DNA, 3790 bp, Homo sapiens
atggaacatcagaggctaagctcaggtggcaacaggatgggtcagatcaaggaagactgagactccggaccaagcctcacggctggtgagggccagggactcaatcacaggaacaagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggaagaaaactgaggtccttaaagataagcttcttgcccaggttcatacaactaataagtaaccagtggggccttgaactactctaacccaagcccagtgatttctctcctttactgcaatttctcaagaagaaaagagagaaatgtctgaagacagttccaaagagaagtctttaaaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagacagtattcacaatagccaaaaggaggaagcaaccaggtgtctatggaagaagaatggataagcaaaatgtggtatatacgtacaatggaatatcattcagcctcaaaaaggaagaaaagtctgacccatgctacaacatggatgaatgttgaggatgttatgctaagtaaaataagccagccacaaaaaggataaatatggaatgattctatatgaggtcactaaagttgtttgcctgtggctctcttttctaaatattttgtaagatgcaactgaaggatcacttcctaaaagctgtttgaacaccagccagtaaagggaccaacaactaaaaaacatgttcgtagcagctgctttatgtcacagtgattattttaaacagataaagaaaacgcctgacgttctatgttaccgcaaatatgtaaaaaactagaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagttcacttgtgaaaaataatatctatgaagatggagagattcctaaaggaattccactattttaccatagagcccaaagtttccttgacccaagcaagaccatcaaggagctatctggattgtatgatactggacctcagtagaactacttttactgaattgctggagccaaaactaggctgcagcaagagaaggcaattagggtacaaaatctaaggaagctgtcattctgaggatcatatgatagatgctgggttaagacatatggctgggcatggtggctcatgcctgtaatcccagccctttgagaggccaaggcaggtggatcacttgaggtcaggagttcaagaccagcctgggcaacatggtgaaaccccacatctactaaaaatacaaaaacagctgggcgtggtggcatggacctctaatcccagttacttaggaggctgaggcaggagaatagcttgaacccaggaggtggacgttgcagtgagccgagatcatgccactcgactccagcgtgggc

SEQ ID NO: 5840 - DNA, 3562 bp, Homo sapiens
ttattccgtatgtaggtcactaaagttgtttgcctgtggctctcttttctaaatattttgtaagatgcaactgaaggatcacttcctaaaagctgtttgaacaccagccagtaaagggaccaacaactaaaaaacatgttcgtagcagctgctttatgtcacagtgattattttaaacagataaagaaaacgcctgacgttctatgttaccgcaaatatgtaaaaaactagaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagttcacttgtgaaaaataatatctatgaagatggagagattcctaaaggaattccactattttaccatagagcccaaagtttccttgacccaagcaagaccatcaaggagctatctggattgtatgatactggacctcagtagaactacttttactgaattgctggagccaaaactaggctgcagcaagagaaggcaattagggtacaaaatctaaggaagctgtcattctgaggatcatatgatagatgctgggttaagacatatggctgggcatggtggctcatgcctgtaatcccagccctttgagaggccaaggcaggtggatcacttgaggtcaggagttcaagaccagcctgggcaacatggtgaaaccccacatctactaaaaatacaaaaacagctgggcgtggtggcatggacctctaatcccagttacttaggaggctgaggcaggagaatagcttgaacccaggaggtggacgttgcagtgagccgagatcatgccactcgactccagcgtgggcaaaaaaaaaaaaaaaaaaaaaaagacatataactagaaacaagataaattaggctgggtgcagtggctcacacttgtaatcctagcactttgggaggccaagacaggaggattgcttgaggccagcagttgaaggccagcctgggcaacatatcgaaacctccacctctactaaaaataaaaacttagccaggtgtagtggtacatgcctatagtcccagccactcaggaggctgaggcaagaggatccctggaacccaggagcttgaggatgcagcgagctatgattgtgccaccatactctagcctggatgacaaacttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtat

SEQ ID NO: 5841 - DNA, 3447 bp, Homo sapiens
atgccaggtatcgtgctgctgttacaaagaacttgatttgtttattttctgaacatgtcggtgatgttttcgtgaccagaaatacaccataggacacaggaacttttttttttagatggagttttgctctgtcacttaggctggagtgcagtggcaagatcttggctcactgcaacctctgcctcccaggttcaaacgattctcctgcctcagcctcctgagtagctgggattacaggcgcaagccaccatgccaggaaatttttatagttttataaaaattttatagctgggattacatgcatgcgccaccacgcccagctaattttcatagttttagtagagatggggttttaccatgttggccaggctggtctcaaacttctgacctcaagtgatctgcccacctttgcctcccaaagtgctgggaatacaggcatgggccaccgtaggaacttaatgtttatgtcagttatcagttagtctatggtaaaattggttttgttatccattgttttgcttaaagtcacagttcctaaattaagtaacgacttactgcagttagatttcatgcccatccatagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatgttagaattgcccctactgtcactacctggagtaacaaaactcctactgcccttcccagccatccacctgcagcctctccctctgacacacagggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgtt

SEQ ID NO: 5842 - DNA, 3897 bp, Homo sapiens
cggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 5843 - DNA, 4119 bp, Homo sapiens
cggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 5844 - DNA, 4012 bp, Homo sapiens
gacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 5845 - DNA, 4104 bp, Homo sapiens
gcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataagattacagccgaagatacatattaaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaa

SEQ ID NO: 5846 - DNA, 4259 bp, Homo sapiens
cggggaaagatgtcgctcccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 5847 - DNA, 4278 bp, Homo sapiens
cggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 5848 - DNA, 4236 bp, Homo sapiens
cggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 5849 - DNA, 3610 bp, Homo sapiens
caggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagt

SEQ ID NO: 5850 - DNA, 553 bp, Homo sapiens
aataagaccatccaattaatggaggactcctttcgcgtaactctccttaaagcggtaggcggtgcgagaaccggctattcagagctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggaattgtactctcagagatgttgagaaaagatacatgggtcttggaagataattactcaaaatatgcagggaagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattcca

SEQ ID NO: 5851 - DNA, 569 bp, Homo sapiens
gaaggtcctcgccaggtgcgtccgcccgttgctttttgtcctcttcgccggtccttaagctttgaggtagagcccaggccaaaactgggaccgcagcctgggtctccgctgccccgcaccagcctgaggcccggtctctggtgacggcgcgcccctagtcttggtttcgggcccggcggaacaacgcctggcatctggactccagtgatcgcgcccgtccgcattcgccgacgtctccactgctgagcaaaagccacccgaggctggcgacagtgtcttgccggggagtagtagccgggctggtaactggagtttgagattaggagactttcagacccttgtgcacaaagaggtgcggtccccgaggcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttct

SEQ ID NO: 5852 - DNA, 3596 bp, Homo sapiens
ctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgc

SEQ ID NO: 5853 - DNA, 541 bp, Homo sapiens
gcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggaattgtactctcagagatgttgagaaaagatacatgggtcttggaagataattactcaaaatatgcagggaagcaggatgaagttaaaggaagtagatcgtacagccatgcaggcatggagccctgcccagaatcaccccatttacctagcaacagg

SEQ ID NO: 5854 - DNA, 3801 bp, Homo sapiens
gttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaa

SEQ ID NO: 5855 - DNA, 3861 bp, Homo sapiens
gcggctgccacgttggaacggaacgtggaggtggccctggccggggaggaggggcggcggcgaatgctgggagagtccgacgagcgctgcactaacgcaggatccggctgccgaaggtcctcgccaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 5856 - DNA, 822 bp, Homo sapiens
ctgggaccgcagcctgggtctccgctgccccgcaccagcctgaggcccggtctctggtgacggcgcgcccctagtcttggtttcgggcccggcggaacaacgcctggcatctggactccagtgatcgcgcccgtccgcattcgccgacgtctccactgctgagcaaaagccacccgaggctggcgacagtgtcttgccggggagtagtagccgggctggtaactggagtttgagattaggagactttcagacccttgtgcacaaagaggtgcggtccccgagggtgaggagaggaaaaaaaatctcaggattactttggctttgcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaac

SEQ ID NO: 5857 - DNA, 847 bp, Homo sapiens
ctcgccaggtgcgtccgcccgttgctttttgtcctcttcgccggtccttaagctttgaggtagagcccaggccaaaactgggaccgcagcctgggtctccgctgccccgcaccagcctgaggcccggtctctggtgacggcgcgcccctagtcttggtttcgggcccggcggaacaacgcctggcatctggactccagtgatcgcgcccgtccgcattcgccgacgtctccactgctgagcaaaagccacccgaggctggcgacagtgtcttgccggggagtagtagccgggctggtaactggagtttgagattaggagactttcagacccttgtgcacaaagagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacag

SEQ ID NO: 5858 - DNA, 4042 bp, Homo sapiens
ctggccggggaggaggggcggcggcgaatgctgggagagtccgacgagcgctgcactaacgcaggatccggctgccgaaggtcctcgccaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggtagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 5859 - DNA, 3635 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggt

SEQ ID NO: 5860 - DNA, 3238 bp, Homo sapiens
agaaggcgtccctgggtagcgcggaaggttacttctctgtgtcccaactcttcctgttttgtttctcccatcaaagtcaaatttctggaagtcatcaagcccttctgtgtcatcctgccggaaattcagaagccagagaggaagtatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttac

SEQ ID NO: 5861 - DNA, 1871 bp, Homo sapiens
aatcacaccgccatgctttgcccacaacagtctcctcaacctgttccctcattccttctcgccagaatctatcaaggctcggcacaaaggtactctcccaggaggccttcctgaattcttctgtgaggcagactacttcccgagctgccccggcccttctccggccaagtctctccagaaactcatcccattcgttctcagatggaaggggacccacacccacgacaagcctccgggtttgcttaatgactcagacagcgagggtgctcgtcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttat

SEQ ID NO: 5862 - DNA, 1893 bp, Homo sapiens
gggagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgcc

SEQ ID NO: 5863 - DNA, 2030 bp, Homo sapiens
gagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaatagaccaaaagtgaagttaagaaggtggaagggagaaggaagacattttacaaaaaggatactcttctactaaaagataaccccgcacggcatttcacacttgcctacgtcaccctgctttccacgcacctcctcagagggaggggctgttattgttcctgttttatgaaaaaagccgagagaggctacagaacctgtttgatgtgatagctaattatggtccgcggagcctcaaaccgagtcgggcctgtgactccgagctgcgctgcctcgtattgattgtcatgcctttctccaaatacgcaccagataaactattgtatctattcagtatgattgttctaactctggctttgagctgtcgaggtggcttctaccttaggtctagtttttggaaaggtgaagcaggagtggaagctctctaagggatacgaaatctgattttatccaaagaaatcacagcagcctttgaaagacacattcagattttcaaacaaacaacagacaattcaaaaccaggcgctctgcttattcactgaaaccgtaagctgctgaaactcagggaaaagcttaagaaactggtcttaaagcttcaggccaaacaatgcttcaaatcacatttgaagtaatcacttaaaaacagtagaaaaatcagttatcaattacctaaaacacttatacccaataaaatattcccatgat

SEQ ID NO: 5864 - DNA, 600 bp, Homo sapiens
gagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcaggcgttactaacattgaaaatatgtggatacactgaagagctatgattggatcagtgtgtttcacccagaaacataggttttga

SEQ ID NO: 5865 - DNA, 2203 bp, Homo sapiens
ggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaagatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaa

SEQ ID NO: 5866 - DNA, 2462 bp, Homo sapiens
aagggcggagtctgcgcggggttgggcggagcctgcgcggggccggtaggatcgcgtcgggagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatatt

SEQ ID NO: 5867 - DNA, 707 bp, Homo sapiens
ggcgaagggcggagtctgcgcggggttgggcggagcctgcgcggggccggtaggatcgcgtcgggagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcaggatcaacacagcccttagacttatcctttgatggcagtgtacatttccatcttgctattataccagaattcatctgactttttacttccttgga

SEQ ID NO: 5868 - DNA, 434 bp, Homo sapiens
atcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagggatttcgcgttgatctgcccattaagtcggcccgttaccgaggacagtacagcagctaccccatcaaactcttctacacctccaacatccccatcatcctccagtcggccctggtgtccaacctgtatgttattt

SEQ ID NO: 5869 - DNA, 778 bp, Homo sapiens
tggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaagtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccc

SEQ ID NO: 5870 - DNA, 632 bp, Homo sapiens
aagtataaccttttcaccaaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaa

SEQ ID NO: 5871 - DNA, 691 bp, Homo sapiens
gcggagcctgcgcggggccggtaggatcgcgtcgggagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaacgtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcag

SEQ ID NO: 5872 - DNA, 314 bp, Homo sapiens
agtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaacgtgagcattaatgcaattaaagagcattctccaaatttgag

SEQ ID NO: 5873 - DNA, 2183 bp, Homo sapiens
gcgtcgggagccggtaccgaggcccgagccgcgggagtcgagcgaaggcagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaatagtgctagagcgtaggaatagaccctggcgtccactgtgagatgttcttcagctaccagagctgtggaaagcaaagaaaacaacttagatcatgccgttaaggaaggacaaaacatcttattcaatcagtgtttgcgcagcagaccaaaagtgaagttaagaaggtggaagggagaaggaagacattttacaaaaaggatactcttctactaaaagataaccccgcacggcatttcacacttgcctacgtcaccctgctttccacgcacctcctcagagggaggggctgttattgttcctgttttatgaaaaaagccgagagaggctacagaacctgtttgatgtgatagctaattatggtccgcggagcctcaaaccgagtcgggcctgtgactccgagctgcgctgcctcgtattgattgtcatgcctttctccaaatacgcaccagataaactattgtatctattcagtatgattgttctaactctggctttgagctgtcgaggtggcttctaccttaggtctagtttttggaaaggtgaagcaggagtggaagctctctaagggatacgaaatctgattttatccaaagaaatcacagcagcctttgaaagacacattcagattttcaaacaaacaacagacaattcaaaaccaggcgctctgcttattcactgaaaccgtaagctgctgaaactcagggaaaagcttaagaaactggtcttaaagcttcaggccaaacaatgcttcaaatcacatttgaagtaatcacttaaaaacagtagaaaaatcagttatcaattacctaaaacacttatacccaataaaatattcccatgatgacaa

SEQ ID NO: 5874 - DNA, 545 bp, Homo sapiens
ctttcgggggctccgtaactttctatccgtccgcgtcagcgccttgccaccctcatctccaatatgcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttata

SEQ ID NO: 5875 - DNA, 462 bp, Homo sapiens
ggcagaaacccggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaatg

SEQ ID NO: 5876 - DNA, 459 bp, Homo sapiens
ggcagaaacccggattccggttccggtgggcctccatcagcaagctccagtgctacgtgtccctggcattttaggtgtcggttgggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaatga

SEQ ID NO: 5877 - DNA, 732 bp, Homo sapiens
attgctaaaaggaaacatggccgggcgcggtggctcacgtctgtaatcccagcactttgggaggccgaggcgggtggatcgcgaggtcaggagttcaagaccagcctggccaatatggtgaaaccccgtctctactgacggtttcagccatccggcggggggttcctggaatgcatccttgtgggaagcgtggccgggcgcacgtcgcgctgcgcttgcgcactgaggtttcgcgtaaggaaccaataggacggaggagtgggcgggctgttggcagaaacccggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaa

SEQ ID NO: 5878 - DNA, 512 bp, Homo sapiens
ggcattttaggtgtcggttgggtaggtgagtttcttcccaccggtcggtacgggcgaacggggcggccacacctttgcgactcttgggggcagcgggcgtgggcgagccggcgtgtctccccgggcggccgtcgcggggcgggcggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaag

SEQ ID NO: 5879 - DNA, 3677 bp, Homo sapiens
aagacggaactgccacaagggcacgcgggcctcaccagctgcctcactctcggatgtcttcccaggtcacccttgacgccctcaggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggatctctttcctttgcaggagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaa

SEQ ID NO: 5880 - DNA, 1721 bp, Homo sapiens
gatccccggcgccgtcgccaggcgctggccgtggtgctgattctgtcaggcgctggcggcggcagcggcggtgacggctgcggccccgctccctctacccggccggacccggctctgcccccgcgcccaagccccaccaagccccccgccctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtgactgccccgcccccgcccccgcccctacaaccgcattaccatagagtcagcgtttga

SEQ ID NO: 5881 - DNA, 4198 bp, Homo sapiens
gattctgtcaggcgctggcggcggcagcggcggtgacggctgcggccccgctccctctacccggccggacccggctctgcccccgcgcccaagccccaccaagccccccgccctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggatctctttcctttgcaggagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttggaaaaaaaaaaaaaaaaaaaaaaaaaa

SEQ ID NO: 5882 - DNA, 4224 bp, Homo sapiens
gatccccggcgccgtcgccaggcgctggccgtggtgctgattctgtcaggcgctggcggcggcagcggcggtgacggctgcggccccgctccctctacccggccggacccggctctgcccccgcgcccaagccccaccaagccccccgccctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggagagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttggaaaaaaaaaaaaaaaaaaaaaaaaaagcaa

SEQ ID NO: 5883 - DNA, 3491 bp, Homo sapiens
ggagactgagcaaaggggggtgggctccaggcgacccctagcccaattctgcccctccatcccaaggggcagagaaattgtctttctttgctgactcctacgaggaaaaaaaaaaaaaaaaaaaaaacaattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaa

SEQ ID NO: 5884 - DNA, 3208 bp, Homo sapiens
agagccgcgagaagaggacagaggagactgagcaaaggggggtgggctccaggcgacccctagcccaattctgcccctccatcccaaggggcagagaaattgtctttctttgctgactcctacgaggaaaaaaaaaaaaaaaaaaaaaacaattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgt

SEQ ID NO: 5885 - DNA, 3173 bp, Homo sapiens
cggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaa

SEQ ID NO: 5886 - DNA, 2919 bp, Homo sapiens
aattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgccc

SEQ ID NO: 5887 - DNA, 4369 bp, Homo sapiens
tcaaaatccatcctgaaggcctgggagccgggcagctgcgcggcacaactccagggggcacactcgccctgcgccctgcgggaatggcgccccggccaaaaaagcaaccagacaaaaacccattgcacgggcgggaactgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattga

SEQ ID NO: 5888 - DNA, 4514 bp, Homo sapiens
cggcaggtggccccgcgcgcggcggccggcccggccgggggcgggcgggaaggtggcgcctcgggcgggggccggtccctgcaccaggtgacctgttccggcccggatccgggcggcctcgccatgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattga

SEQ ID NO: 5889 - DNA, 3500 bp, Homo sapiens
cacactcgccctgcgccctgcgggaatggcgccccggccaaaaaagcaaccagacaaaaacccattgcacgggcgggaactggtctgtgcgacccgcaaaagggaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaa

SEQ ID NO: 5890 - DNA, 553 bp, Homo sapiens
ttgcaaaggacacaaaaggccgacttaaaagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttat

SEQ ID NO: 5891 - DNA, 605 bp, Homo sapiens
ggtggcggcggcaccacacaaaaccctcgggaaacatccagaacgtgccgcgaaccagccggcagggtggggcgcagcccggctgcaaacatgccagcaaggaggcagtcccaaccccgcagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttc

SEQ ID NO: 5892 - DNA, 558 bp, Homo sapiens
aaagagcgcagtggtggcggtggcggcggcaccacacaaaaccctcgggaaacatccagaacgtgccgcgaaccagccggcagggtggggcgcagcccggctgcaaacatgccagcaaggaggcagtcccaaccccgcaggtggacaggtggagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaa

SEQ ID NO: 5893 - DNA, 1439 bp, Homo sapiens
cggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagagggtcagtggaaacaagggtgggccttgtgaggtgtggggaagccctgggaccctcactccccttccagtgtgtaactggattggctcccaccagcccagaagatttacgacgtgggaaatggtatacttggattaaaatatttcatccagatttgtttacatctagagagaaccccttgtaggttataaggaaactttttaacattcttccttgaatatattttctgtagctgaaaatgtttgtgaagtggctgtcaactacacatcgcatgagtagaggggctctgggtcggggtttcatatgcagcagagcagctcccttgctgccgtccatcaagagccctcaacacaagagtttgttataaatagaaataaacgacaaaaagtagaggggtatgtttaagtacactattagatgtgactgactaccttgaaacctgatttttttccatggggagaaacagtgcttgaattctgcatgccccccttgcatctagcaccttttggtaggggtggaaggagggtgtcagggagaatgattaggagataatggaggggaggggaaacttgcgttgtgtaatagcatttgaagagcactta

SEQ ID NO: 5894 - DNA, 1188 bp, Homo sapiens
agggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacctctaactatta

SEQ ID NO: 5895 - DNA, 1292 bp, Homo sapiens
acgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagagggtcagtggaaacaagggtgggccttgtgaggtgtggggaagccctgggaccctcactccccttccagtgtgtaactggattggctcccaccagcccagaagatttacgacgtgggaaatggtatacttggattaaaatatttcatccagatttgtttacatctagagagaaccccttgtaggttataaggaaactttttaacattcttccttgaatatattttctgtagctgaaaatgtttgtgaagtggctgtcaactacacatcgcatgagtagaggggctctgggtcggggtttcatatgcagcagagcagctcccttgctgccgtccatcaagagccctcaacacaagagtttgttataaatagaaataaacgacaaaaagtagaggggtatgtttaagtaca

SEQ ID NO: 5896 - DNA, 3986 bp, Homo sapiens
aaatcctggaagctcagggtcgtgaagaggaagtccagccgcgctatgcgaggtcttcctgtttttggagggggcaggcaccccagggccgattgtcgcgaatcaccttcacctctgggggctcagaatccctgagccagaaggccagggcagggctgggggatacccctgctgctcagacaggaaaatgggctcggagcttgcccaatacttcccagaaggacgaggctgctgaacttctcattcggggctccgggacctggactgtacccctttctggcgtcacctcctcctgtcgcctggccctcgccatgcagaccccgcgagcgtcccctccccgcccggccctgctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggctcagtgtcttcctggaggagtttgagacctaccggccggacaggtgtggacggcccggcggtggcgagacagggcagcggctgctgagcttggagctggacgcagcttcggggggcctgctggctgccttcccccgctgcgtggtccgagtgcctgtggctcgctgccagcagtactcggggtgtatgaagaactgtatcggcagtcaggacccctactgcgggtgggcccccgacggctcctgcatcttcctcagcccgggcaccagagccgcctttgagcaggacgtgtccggggccagcacctcaggcttaggggactgcacaggactcctgcgggccagcctctccgaggaccgcgcggggctggtgtcggtgaacctgctggtaacgtcgtcggtggcggccttcgtggtgggagccgtggtgtccggcttcagcgtgggctggttcgtgggcctccgtgagcggcgggagctggcccggcgcaaggacaaggaggccatcctggcgcacggggcgggcgaggcggtgctgagcgtcagccgcctgggcgagcgcagggcgcagggtcccgggggccggggcggaggcggtggcggtggcgccggggttcccccggaggccctgctggcgcccctgatgcagaacggctgggccaaggccacgctgctgcagggcgggccccacgacctggactcggggctgctgcccacgcccgagcagacgccgctgccgcagaagcgcctgcccactccgcacccgcacccccacgccctgggcccccgcgcctgggaccacggccaccccctgctcccggcctccgcttcatcctccctcctgctgctggcgcccgcccgggcccccgagcagccccccgcgcctggggagccgacccccgacggccgcctctatgctgcccggcccggccgcgcctcccacggcgacttcccgctcaccccccacgccagcccggaccgccggcgggtggtgtccgcgcccacgggccccttggacccagcctcagccgccgatggcctcccgcggccctggagcccgcccccgacgggcagcctgaggaggccactgggcccccacgcccctccggccgccaccctgcgccgcacccacacgttcaacagcggcgaggcccggcctggggaccgccaccgcggctgccacgcccggccgggcacagacttggcccacctcctcccctatgggggggcggacaggactgcgccccccgtgccctaggccgggggccccccgatgccttggcagtgccagccacgggaaccaggagcgagagacggtgccagaacgccggggcccggggcaactccgagtgggtgctcaagtcccccccgcgacccacccgcggagtggggggccccctccgccacaaggaagcacaaccagctcgccctccccctacccggggccgcaggacgctgagacggtttgggggtgggtgggcgggaggactttgctatggatttgaggttgaccttatgcgcgtaggttttggttttttttgcagttttggtttcttttgcggttttctaaccaattgcacaactccgttctcggggtggcggcaggcaggggaggcttggacgccggtggggaatggggggccacagctgcagacctaagccctcccccacccctggaaaggtccctccccaacccaggcccctggcgtgtgtgggtgtgcgtgcgtgtgcgtgccgtgttcgtgtgcaaggggccggggaggtgggcgtgtgtgtgcgtgccagcgaaggctgctgtgggcgtgtgtgtcaagtgggccacgcgtgcagggtgtgtgtccacgagcgacgatcgtggtggccccagcggcctgggcgttggctgagccgacgctggggcttccagaaggcccgggggtctccgaggtgccggttaggagtttgaaccccccccactctgcagagggaagcggggacaatgccggggtttcaggcaggagacacgaggagggcctgcccggaagtcacatcggcagcagctgtctaaagggcttgggggcctggggggcggcgaaggtgggtggggcccctctgtaaatacggccccagggtggtgagagagtcccatgccacccgtccccttgtgacctcccccctctgacctccagctgaccatgcatgccacgtggctggctgggtcctctgccctctctggagtttgcctcccccagccccctccccatcaataaaactctgtttacaacca

SEQ ID NO: 5897 - DNA, 3802 bp, Homo sapiens
agcgcagcgcaggacctgggtacgccgcgaggaaccgtgcagcccagcgcggccgcccggcccgggtccagcagccaggagagcgcagcgcttcgaagccgagtgcgcgccaccgcccgcgccccgcgctggggaatgcgccctcggcgcgccggccagggggcgcccgcagcccaccccaggggaggcggccccgagcgcccctgagccttcccatggcccgggctggggcccgggccctcggctgctgacgcgcccgaagcccgcggaaccggttaagccgcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggccacaccatggacccagactcaggcggtcagaggccgcggcagcagagccacggatggtgccctccgcccgatgcccacagccccacgccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagaggggcccaactaccagtggatgcccttctcagggaagatgccctacccacggccgggcacgtgccctggtggaaccttcacgccatctatgaagtccaccaaggattatcctgatgaggtgatcaacttcatgcgcagccacccactcatgtaccaggccgtgtaccctctgcagcggcggcccctggtagtccgcacaggtgctccctaccgccttaccactattgccgtggaccaggtggatgcagccgacgggcgctatgaggtgcttttcctgggcacagaccgcgggacagtgcagaaggtcattgtgctgcccaaggatgaccaggagttggaggagctcatgctggaggaggtggaggtcttcaaggatccagcacccgtcaagaccatgaccatctcttctaagaggcaacaactctacgtggcgtcagccgtgggtgtcacacacctgagcctgcaccgctgccaggcgtatggggctgcctgtgctgactgctgccttgcccgggacccttactgtgcctgggatggccaggcctgctcccgctatacagcatcctccaagaggcggagccgccggcaggacgtccggcacggaaaccccatcaggcagtgccgtgggttcaactccaatgccaacaagaatgccgtggagtctgtgcagtatggcgtggccggcagcgcagccttccttgagtgccagccccgctcgccccaagccactgttaagtggctgttccagcgagatcctggtgaccggcgccgagagattcgtgcagaggaccgcttcctgcgcacagagcagggcttgttgctccgtgcactgcagctcagcgatcgtggcctctactcctgcacagccactgagaacaactttaagcacgtcgtcacacgagtgcagctgcatgtactgggccgggacgccgtccatgctgccctcttcccaccactgtccatgagcgccccgccacccccaggcgcaggccccccaacgcctccttaccaggagttagcccagctgctggcccagccagaagtgggcctcatccaccagtactgccagggttactggcgccatgtgccccccagccccagggaggctccaggggcaccccggtctcctgagccccaggaccagaaaaagccccggaaccgccggcaccaccctccggacacatgaggccagctgcctgtgcctgccatgggccagcctagcccttgtcccttttaatataaaagatatatatatatatatatatatataaaatatctatattctatacacaccctgcccctgcaaagacagtatttattggtgggttgaatatagcctgcctcagtggcagcatcctccaaaacttagacccatgctggtcagagacggcagaaaacagagcctgcctaaccaggcccagccagttggtggggccaggccaggaccacacagtccccagactcagctggaagtctacctgctggacagcctccgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagcctcttcagccccttctcccctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctctgggactaga

SEQ ID NO: 5898 - DNA, 936 bp, Homo sapiens
cccgcgcggctctgagcgccccgtcccgccggcggccgcgagaccagagcgagcgaacgaaccgcggcggtccggagagccccgagcgcagcgcaggacctggagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgca

SEQ ID NO: 5899 - DNA, 757 bp, Homo sapiens
gcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtgagtgcagcgggaaccgggagggagcgggcaggcggccgggccaccccgcgacccctctgggacccgcggcactgcaactccgcagaagtgtccggggagcgggtctcgtcgagccggggggctgcccgcggacataggggcaacaaggctggggtgggattcttacctgtcctggaggcccggaccccttacctacggggcggcgtatggatgtgtggatgatgtggcctgcggggtcacccatgtgcaaagcaactttttcctgcaaggttctgggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattgta

SEQ ID NO: 5900 - DNA, 3541 bp, Homo sapiens
ctgactggtgctccctctcttccatcttgggctgtctgcatgtgtctcattcccccactctctcctgtgcctcccctctaccgtaataatcaggtccaggtttctctgtactgggagaagacctgtggctggagcaggcagggatgcaccctatctgttccccattcctccaggtgggagggagaaggagtaacccactttattggccacagatgcaggggagaaaggagaaagcatgctgggagctggaaagagccctaagatcacctggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagaggggcccaactaccagtggatgcccttctcagggaagatgccctacccacggccgggcacgtgccctggtggaaccttcacgccatctatgaagtccaccaaggattatcctgatgaggtgatcaacttcatgcgcagccacccactcatgtaccaggccgtgtaccctctgcagcggcggcccctggtagtccgcacaggtgctccctaccgccttaccactattgccgtggaccaggtggatgcagccgacgggcgctatgaggtgcttttcctgggcacagaccgcgggacagtgcagaaggtcattgtgctgcccaaggatgaccaggagttggaggagctcatgctggaggaggtggaggtcttcaaggatccagcacccgtcaagaccatgaccatctcttctaagaggcaacaactctacgtggcgtcagccgtgggtgtcacacacctgagcctgcaccgctgccaggcgtatggggctgcctgtgctgactgctgccttgcccgggacccttactgtgcctgggatggccaggcctgctcccgctatacagcatcctccaagaggcggagccgccggcaggacgtccggcacggaaaccccatcaggcagtgccgtgggttcaactccaatgccaacaagaatgccgtggagtctgtgcagtatggcgtggccggcagcgcagccttccttgagtgccagccccgctcgccccaagccactgttaagtggctgttccagcgagatcctggtgaccggcgccgagagattcgtgcagaggaccgcttcctgcgcacagagcagggcttgttgctccgtgcactgcagctcagcgatcgtggcctctactcctgcacagccactgagaacaactttaagcacgtcgtcacacgagtgcagctgcatgtactgggccgggacgccgtccatgctgccctcttcccaccactgtccatgagcgccccgccacccccaggcgcaggccccccaacgcctccttaccaggagttagcccagctgctggcccagccagaagtgggcctcatccaccagtactgccagggttactggcgccatgtgccccccagccccagggaggctccaggggcaccccggtctcctgagccccaggaccagaaaaagccccggaaccgccggcaccaccctccggacacatgaggccagctgcctgtgcctgccatgggccagcctagcccttgtcccttttaatataaaagatatatatatatatatatatatataaaatatctatattctatacacaccctgcccctgcaaagacagtatttattggtgggttgaatatagcctgcctcagtggcagcatcctccaaaacttagacccatgctggtcagagacggcagaaaacagagcctgcctaaccaggcccagccagttggtggggccaggccaggaccacacagtccccagactcagctggaagtctacctgctggacagcctccgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagcctcttcagccccttctcccctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctctgggacta

SEQ ID NO: 5901 - DNA, 1693 bp, Homo sapiens
agcgccccgtcccgccggcggccgcgagaccagagcgagcgaacgaaccgcggcggtccggagagccccgagcgcagcgcaggacctgggtacgccgcgaggaaccgtgcagcccagcgcggccgcccggcccgggtccagcagccaggagagcgcagcgcttcgaagccgagtgcgcgccaccgcccgcgccccgcgctggggaatgcgccctcggcgcgccggccagggggcgcccgcagcccaccccaggggaggcggccccgagcgcccctgagccttcccatggcccgggctggggcccgggccctcggctgctgacgcgcccgaagcccgcggaaccggttaagccgcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagaggggcccaactaccagtggatgcccttctcagggaagatgccctacccacggccgggcac

SEQ ID NO: 5902 - DNA, 3781 bp, Homo sapiens
ctccgggtccccaggggctgcgccgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaatcctggctct

SEQ ID NO: 5903 - DNA, 2512 bp, Homo sapiens
atttccggggacgccgcgccggactgaggctgtgcgcccgagactccgggtccccaggggctgcgccgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggtgagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctgggctcggacccaactcctggacctttccagcctgtatcaggctgtggccacacgagaggacagcgcgagctcaggagagatttcgtga

SEQ ID NO: 5904 - DNA, 3807 bp, Homo sapiens
cgccctccgccgcttgcgggtgagctctgcccaagccgaggctgcggggccggcgccggcgggaggactgcggtgccccgcggaggggctgagtttgccagggcccacttgaccctgtttcccacctcccgccccccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaatcctggctcttcctct

SEQ ID NO: 5905 - DNA, 533 bp, Homo sapiens
gagatccgtggcaacccgtctgtgcatccccgctacccacctaggcatacctgttcctgcccactctctgggatcagcatcagaaccaagagcaaggctctgtctgggagtaagagtggcagccaccaggtgacctgaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctcttt

SEQ ID NO: 5906 - DNA, 559 bp, Homo sapiens
gttaaacggcatcttccttggatggtctcaggatcacagccttctctaaagaagtattcctctccaaagagctgcaggccttcaacagccttattaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgc

SEQ ID NO: 5907 - DNA, 585 bp, Homo sapiens
aacatgtactgatgctgcagctgagctgctgcccagcccctggggagaagacaccagcagcatgcccagccagggcagggtggagagctgcagctgcaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagctt

SEQ ID NO: 5908 - DNA, 3545 bp, Homo sapiens
gcgagcgcgggcaggcggcgacgcgggggcaggggtggacggcggtcagagccgaacgcgagggcggcgcccggggactggagctgcgcgcaataggacagctggcctgaagctcagagccggggcgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccatgcccgctggacctttgggggccgggacctgcctgcggaacagcccgggtccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaacgattgctctgatggggctaaga

SEQ ID NO: 5909 - DNA, 817 bp, Homo sapiens
ccctcttgggcaacaaaggggcctcgggaagctgggccccttcgctcccggcccttctcacactcctgccctgctgatgtggaacggggtttggggttctgcagggctattgtctgcgctggggaaggggacaggccgggaccgggacctccgctcgcagccggccgcaccagcaggacagctggcctgaagctcagagccggggcgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatga

SEQ ID NO: 5910 - DNA, 839 bp, Homo sapiens
tagggctcatgccacttgttaatcagccttccagtggcacgaggagtcattttctggggataggcgctttgcccaaagcgtgagaagcaggagcaggccctttctgttgattgaagggtcttcctggctggtgaagccctttccagacttgagggcagggaccagtggtcctcggggcctagaaagaggcagaattgggggccaaacggcagacccctctggtccgccccaaaagacgcctcggttcccccagcgtgcctcccctggatactcgcctcgacgtggctcgcccgcggtcgttcctgcaactgcacggtcgggagtccctctccccagcccagcccgcccggagtcttcgggggacacttcagaaagatcggcaggacagctggcctgaagctcagagccggggcgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgt

SEQ ID NO: 5911 - DNA, 3146 bp, Homo sapiens
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggc

SEQ ID NO: 5912 - DNA, 4503 bp, Homo sapiens
actctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatcctt

SEQ ID NO: 5913 - DNA, 563 bp, Homo sapiens
agtcaggacagacgtcccaggcgagcagaggccctgcgtgaggatggggcggcggggccagatggtgtcctgagtatccatcctccctggtggctgaggacacgctgaccagcgtggggtcaggagcatggcccctggaaagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaagg

SEQ ID NO: 5914 - DNA, 1837 bp, Homo sapiens
agcccagagaaaaacaacagaggtttgcggcagaagtggccaatgtcgggcccagagtccatgctcaaggctggaagcccatcctggatgtgctgcactcggcagtcctagtgtaattctgcagggcctggcccctgccagggtctgagctctccagcctgtggcatctactcccctccaagcccaccccagtgtctcaattggagagacaggccctcatggtccccactctggcccagccccctctgcacacagctggccgagctctgggcctctccatgctgtggccctggtgatggcagagccttgggatgtctctgtccatgtggtcacaggacatgtgtgtggcagcagggccatggtggggtgggatgctgttccaaggcccagaaccattctgtaagaaaccagcacagcgctgcaagaaagggggtcctaggggacacaggccacacaggtgtgctttgaaaaatggcaattaaggtcaaagagcaggaagtccacaggacgggccaaggccaaggctcccgctggccatggggaagccacctccagggcagtcccagggactgaattggaagttgtcccaagtcacttcaggtccaactgggacagcagaggtaacccccctgcaccctcatggggcagcttctttgggtcctaaatgtggactcagaggtggaaacggtctgtgtccccaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatgg

SEQ ID NO: 5915 - DNA, 433 bp, Homo sapiens
tttggtcgcggaggccgcggaccctgtgcactggacccggcgccgcgcactcagacagactctgctaacaccagatagtggaaagaaaccatgtgctgaaatgtttgacgacactgatggtttgcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatg

SEQ ID NO: 5916 - DNA, 907 bp, Homo sapiens
agagcccttgaaacccctgcagtcaggacagacgtcccaggcgagcagaggccctgcgtgaggatggggcggcggggccagatggtgtcctgagtatccatcctccctggtggctgaggacacgctgaccagcgtggggtcaggagcatggcccctggaaagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctgg

SEQ ID NO: 5917 - DNA, 4275 bp, Homo sapiens
actctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatggaatgagtctcatgagtgttttgttctacctgctttcaagtctctaattattaaagctgtatctctgaagactgtgtcactgtgtgtgtgaacttgtcctaaagctactcagcctttaatcttacacacacgtctcttcttgtctgttgaatgacagttttcatgtctatcataaaaccaaagcctctgttaaaagtcaagccgcacccctctggtgatcctagcaaatactgagtgtcttcccagcagtgtgacaatgacctgttttgcatcccctctttctggagctggacaaattctctaccagcctttgtgtgggatcagcatacatcgcctgctaattccttcaggatccatcacaacaggtgtcctgaagatgctggagacaccctggttgtctccacacgttccccctccgcaccccaagtcgagaggcccagctgcctgtgaggtgtgtgcttgcccatccagccaaggatgccagtcttgctcacggaaccatcacatactcataacctgaagttttcctgtaaaatatccatcagctcactgtggttcttgctttgggtgtggcttcaaccactacaaactgatgagtgaaatgctatgggctttaggcttatattcttggtgctgttttctgtctcttctcctgaagtctggatttcaagcactttcacacttaacaaaataattacatacttgaagttttcgtaatgtggagtgttctactgggaaatggagttatgaggatgaatttctgagtctttctttgctctgctggaaaaaataaaaatagagttgtacattg

SEQ ID NO: 5918 - DNA, 4382 bp, Homo sapiens
agcgctctcgcgcgccgcagcatcccagccgccgctgccgccgccgggcctccccgccaccccctccccggcccggccgcctcccgccgctgccgccgccgccgccgccgccattcctggcgcccgaactcgcccggccgggagccgccgcgggcaggacgcgcgctgcagactctgctaacaccagatagtggaaagaaaccatgtgctgaaatgtttgacgacactgatggtttgcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtg

SEQ ID NO: 5919 - DNA, 602 bp, Homo sapiens
ggtagctggaggagcgggaagcactgactcctgaagaccctggcttcgctttcctgtgtccgttgggctgtccacttctaagactctctttgtcccccgctgccttccgtattcctcagcagatggacccggcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcact

SEQ ID NO: 5920 - DNA, 4824 bp, Homo sapiens
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttga

SEQ ID NO: 5921 - DNA, 5684 bp, Homo sapiens
attacgtggctcctgtgttaatagaatcatggagggatcagcgtcggctcctgagcgtctgcagtcctgcacgtggctctggttttgcgattctgattctcttgatctaattgttggtgctgctactgcaccccacgatccctgtcttgagactgatctcccacactgcaaaggagtgacagccatgctatggaaccttgccacaccacggtggacaccgttctgtttggctgaaaaccagccatccaaaaataaaggaagatgaacagctctttagtgcttgtaattatgccatatgtgtttctgctttttccttctttgcctcatgaagatgaattttaaaggatacatatctggagctaatagacaattagatagtacttttttggttcacagactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttgatttggggaagacattccttagcggaggctgtgcagcctcccgcccctgcatggcccaggcgggacagctgggctcgctcttttctgtccgtttcctgctgtgttttgccctctctggcctgtgacgtgctcctggcgacttcttcctcagtgccctctcttttctgtcctctctgtctcacagcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtgagttgggccctctctgtcccctgtgccctgtccatctgtctcctcccacaggtggggggcgggcgggggcatcctccacatccctccacatgttcctttaccttccttatctgtcctggctgcgtccctcgggttgagccgtttcacgctttcattgtgggtccatcccgagggaaactgtagacagtgtgaagccacttctagtgtacaggggtcaaccagtgttttctgtaaagggctagatatttaggccttgtgggctgcaggctgtgtcacagccactaagctctgctgttgtattgtaaaaccagccatagtcaatacacaacgagtggtcagggctgtgtgccagtaaaactttatttataaaaatgcacggtgggccagatttgccccaaaggccccagtttcccaacctgtggtatataggattgcttctccctt

SEQ ID NO: 5922 - DNA, 826 bp, Homo sapiens
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcc

SEQ ID NO: 5923 - DNA, 4312 bp, Homo sapiens
gggggcggagccgggcggtgtttcatccctcagcctcaggctgagccggaccgagccgagaggacccgagtggggccgaggccagtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagaggacgaatgtcacaattttgtccagattctcgccattgccaatgcctctcacctcctcacttgtggcaccttcgcttttgatccgaagtgcggggttattgatgtgtccaggttccagcaggttgaaagacttgagagtggccgggggaaatgtccttttgagccagctcagcggtcagcagctgtaatggctgggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgtaaatacatagtgttcataagagacctggccacatgtgcatgaatgactgggccgatgcttaggaatatttatgagggatggggagggagacaattggaatgggggcgttgcctgcagaactttagaccctgtagccatagagggaatggcgttcctttctaaaaggaactgaaacactgcccctctccccattgccccacaaccttactctaaatttgagtagagaaaagctcctaaagtgaccttccgggtgggaagggcagcagtacacatgaccccatccttttctttgtttttaccccctggctgccaccactgccatgtcacagctgctttctctggctggagtgtaggctgtaccccatttccttggctcccattaaaaatcaacaacattctaatgattagggaacaacagaaggggaacagtcataggatatacgagcagtataaagatacgtttgcaatcagtgactactcagggtgacacccttgccctaaagcaggagtcccccctacctggggtccatggactccctgaaattgtatgcaaaatgttgtttgtacatgtgtgtctgtatgtctctgtggggaggttttatggcttttgtcagattttcaaggccttaacaaagttaaaggaccactgccctgaggttactgcactgaggccaagttaggatggcatcactctgtggcagctctccctggacttgccctgcctggaacagggtgatttgctggaatggagttaccactgagatgccaaaggttgctgggtctggaagactgttgtggcctctcagttctctttgagtctgactgactgtggccagtccctggactggtagctgctggaggccttcttgtttctccagtccctggaagctgagctctatgtgtatttgatgacattgtcagctcttaccaaacgtcaagacctcttcctgcttgaccactcgcacatggctctaggcttctcctgctgagtcctggtcttggcctgtgaatgtgcctcgttcatccctggtgcttgagcccctcaagctccagtcaatgatccagtccttcccctttgaagttttctgctctactttccttggcagcagcctgtgaactactcaaaagagtccccttgggtttggaattatcagtggctttgccactagtaaatgtgtgatcttcggcaagtaacctaacctagggacatcagtttactcatctgcgaagtggggataataaaacctacctcagggttgcttcaaggattaaatgagaaaatatgtcaacaataaagacctgtctgtaccaata

SEQ ID NO: 5924 - DNA, 2672 bp, Homo sapiens
caggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagagggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgta

SEQ ID NO: 5925 - DNA, 4094 bp, Homo sapiens
gcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccagggaagcaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccac

SEQ ID NO: 5926 - DNA, 3596 bp, Homo sapiens
cagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcct

SEQ ID NO: 5927 - DNA, 2655 bp, Homo sapiens
gctgtggggccgcggagccgcgcgtcgctgtctctatggccccggatccgagcgcaaagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagct

SEQ ID NO: 5928 - DNA, 2675 bp, Homo sapiens
ccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccagggaagcaggacagcactgatacaggacatagagagaggaaatcgaggctgtgagagcagcagggatacaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttgga

SEQ ID NO: 5929 - DNA, 596 bp, Homo sapiens
gctggtgctgtggggccgcggagccgcgcgtcgctgtctctatggccccggatccgagcgcaaagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggctt

SEQ ID NO: 5930 - DNA, 2024 bp, Homo sapiens
cctctcgcagctggtgctgtggggccgcggagccgcgcgtcgctgtctctatggccccggatccgagcgcaaagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagac
